United States Patent 10,233,495 (METHODS AND COMPOSITIONS FOR SCREENING AND TREATING DEVELOPMENTAL DISORDERS) - sequence listing, part 178

SEQ ID NO: 1096 - DNA, 4745593 bp, Homo sapiens (residues 3,163,731-4,745,593 of 4,745,593)
  misc_feature (38284)..(88283): n is a, c, g, or t
  misc_feature (258953)..(308952): n is a, c, g, or t
  misc_feature (347264)..(447263): n is a, c, g, or t
  misc_feature (1469658)..(1519657): n is a, c, g, or t
  misc_feature (1801190)..(1851189): n is a, c, g, or t
  misc_feature (3417845)..(3467844): n is a, c, g, or t
  misc_feature (3653165)..(3703164): n is a, c, g, or t
  misc_feature (3875954)..(3925953): n is a, c, g, or t
  misc_feature (4146267)..(4196266): n is a, c, g, or t
  misc_feature (4651452)..(4701451): n is a, c, g, or t
acaaggacaacaacaacaacaacaacaacaacaacaacaacaaaccaatcaacccaagtatgctagatgggtaaaagacttgaacagatacataagaataaaaggtacacacatggtcaacaaagcatatacaatatgtttagctctcaggaaaatggaaatcaaaaccacattgagacaccactataactcccagtagcatggctaaatttataaggagaggaaacacccaatcttggagaagatgaagaacaaccacaactctcacacgtcattgctggaaatgtaaaatgacacaactactttgggccaagttttgtgagtttttatgatcttgcacatatctcactctttggtaccagcaattaggcaactaggttttccccaagagacacgaaaacaggtgccctcaaaatctcttgtgggaagaaagttcaaagccggcttattcagaatacccaataccggtttattcagaatagccaatacccagacgctcattatcggggtggaggtggggcgagaatggcaaacaaactgtgctgtctctttgcaatggaatactactcagcaatgaaagaggaatgaacttctgctacactcagcaatggatagagccagagacattatgcagagagaaagaagcatgtagaacagagtagatgcaaggtgattccatctgcgtgaagttctacaagcaaaggtaaagtgaaaacaatctggagagtgattgttcacaaataaggcagaggacaatgataatgatttttataattctagtgattacgttattgattgagtagtcactaaatccaggcccgtctgacaacagcagtgtaaggcagagttcccaaagaggcccaaccttccacagaaaaatgttgaggcacataaaatttaagatagttaaccaaggtcaggcaagggctgacatagatttctaatacagaacctgggttcttggacatagattagactggacctgtccacttctctgtttcagatgtctctgggattctcagctgcatcagaggagagacagaaggacagagaaggagacagagggagagaggagtagggaagaaatggagggaggcacagggcccatagctgtgaaacagcagagaagtaactcttgccagtgtatttacagtatacagaagttttctggtgatcaggacattagcagatgctaagtttgctgtggtcaggagatgaatttgatatgccatagatttagaaattaaaacgaaaccctaaagttattggaagagaatgtagcagaatacatttctgccttaagagataacaggaaaaaataaagcaaagtagaatttcaccaaagttatcaacttctgctcatcaagaatcaccatgagaaagtgagaaggtgagccacagactgggagaagataattgcactgtgtttacctgaaaaaaaaaaaggctcaaattttgaatatagagagtactttttacaaatcagtaataaaaagcaaagccaattgaattagggaaaatgcttcaaagcctgtcttctcaaagaaggattgctaaacggtgaaaaggcattagaaaatatgctcaacagcattactcattaaaggaaacacaaattgaagccacgatgtggtaccgttttacatccaccagaacaggtgtatttaaaaaacagtaaacaccacgcgctgtcaaggatgttcagccagtggaactctccttgctggtgagaaagcattctggaagaaaccatttggccgtttctaataaagttaatattacacctaccctatgatccaacaattccagtacttggtattcctcaagggaaatgaatgcacgtgtccacaaaaagacctatacaagaagaattttcgttcatcttgtccagcaagtggcatcggtttcctatcagcaggagtctgaacacttctggccctagcctcttggtatcagagtcgccaaggaaatacaaggcagtcagagactggacgggagaacaacacattattcatacagagaggagacagagcggggtgtgggctccgcttcagtcttgggcgttggtcccccatggccagcaggtccctccatttggcctgcacacacagcctcttgagaagcagaagaaaggacccccgcttcctcccctcagtggggggcagatacagcagctggccaggtgccagttgatgcacatgcttaagtggaacaaaggggtacacaccaagtctgatcgggggaaagatactcccacacaaggaggtgagtccagcacaggctgtgatgactccttatctctcaggaaggaagtgctccaggcccaaggcccattcctacgtggcagagtggaggtggaaagacccctggcaccagattgcctttcctcacactttgctgttggcatacaaacttggtgacgggcacagagacaagccattgtaggccacaacaaagagtttggagtttaaagtcattaaaagcttcttgtcgtttcgtgtgtaacagccccagtgactggaaaacaggtcctgagcacaccattgccttcgtgtaagccaccaccaacagggctgactgggttatttgctctgtgaggctcagagacaggacggtgcacgtccagagtttcccttggactcctccccaggtgagtgagctgtgaggtctcttttccttaccccgacgtgcccccagtgaccagaagaacggttctgagcacaccattgccttcgtgtaagccaccaacagggccgactgggttatttgctgcgtgaggctcagaaacaggagggagcacgtccagggtttcccttggattcctcgccaagttagtaaggtgtgaggtctcttttccttcccctgacgcgcctggttgcgggagcaaaagggaagagctgacagcctagactaacgacattgccgtgactcggattcgaaccgaggttgctgcggccacaacgcagagtactaaccactatacgatcacggcgagccacaggctaagccgcgatggcggagcttgctctagcccttttgacgtcaatggatttcgattattaggcggattcgttcccagacagccacaggggactcgcgcttttctttcatgcccgctctgcttttccctcccttcctcccaatcttcatacgtgatgagaacaattctcatctcctccactccagcctgggcctccctgcaccagcctctctcgggaggtctctctgtcctggtccgcacctcctctgcttctgtggggcctctccgtatttctgcttttcacccctcctctctcccgccccaccgaccgaggccgaggtgagcgaggggagcgcaagcagcagtagagaatcgggtgaaggcggagccaagaaggggaagagccatcactagagcccacggggcgttctgcttgcttcccctgggacccacgcggctcaggcccagggagtcgcggacccgggcgtttcctgggatgctgggtctgacgcctgcgagggtcaggacggggcgaaggccattccgctgcccttccagcttcggaatcacccaatgcacggcaagatgtgccggcaagatgtgcctctcaggttttccgaggctttggagcctgcacaattgttctacaaaaggcagtagctccgccgaacgttggatcgtcccttggtctggtgataccagaacgagagttgactgtgtgtctcagtcggttggtatgcttgcttccaagcctggaggtgggtggttcgagcctgttctatagagctatttcttgcattttaaaaatgcttaaaccgctggcaactttcttctatcgagcacatggtttcatggaaaggcagagcgagaccaactttaccctccactcctccttgtctcgcgtaggacaagaggaagtaaatcaaggtccactaggattctgggaactctctctcacctttttttttttttttttttgagaccgggtctccctctgttgcatagctggagttccctggcgcgatctcgcctcactgcaacctccgaccctctggttcaagcaattctcctgcctcagccccccgagtagctgggattataggcatgggccaccacgcccagttaagttttatatttttagtagagaccgggtttcaccatgttggccagggtggtctcggtctcctgacctcgtgacccgcccgcctcagcctcccaaagtgctgggattacaggagtgagccaccgcgcctggcgccctctctctctctctctttctctgtctctctaactgtcattcatttagccctttccatacgcttttgaggttaaattggttctgtgattttacaattacatataatgctctagtcattcttgtacgggcattgtcatccactggtgtataagtatttctataggatagaggtgcaattactatagaaagagcaattactctatcatagtgtccacgctgtttttatatcattccattctctctcctcttttggcttattagctataactctttcatttgttattttagtaattgccttagggcttatagccaacctttttaacttatcacagtcaaccttcaagtgatgttatacctcgccttctggccttgatgctattgctgacatgcactttacctttgggcatgttataaaccccacaacccattgttgcttttgtttaaatggtcaaattttcacaaaagaaatttacaaaataagaaaatacctattatagttacccatttctggtgttcttcatttcctctggaaatgaagatctggatttttgtctggtattgggttccttctgcctggaggactcctttcacggtttttgtagtgtggctcagctggctgctagtgaattcggtcagcttttgtacatctctaaatgtcatttttttttttttttttttttttttttttgagatggagtctcgctctgtcgcccaggctggagtgcagtggggcgatctcggctcactgcaaactccacctcccaggttcacaccattctcctgcctcagcctccccagtagctgggattacaggcacccgccaccatgcccggctatttttttgtatttttagtagaggcggggtttcaccgtgttagccaggatagtctcaatctcctgaccttgtgatccacccacctcggcctccctaagtgctggggattacaggcttgagccaccgtgcctggcctaaatgtccttatttcacttccagttttgggaatttattttttctggcatagtattctaggttaacttcccctgccctcagtaccttaaagatgttgcttctctgtctgctcgtgtgcattgctgctcctggtagaggccggcaagagcagaaaggaagctgatgcaatcctcatctttgctcctgtgtatgtacaatgtctttttcttctggccagatttgagcaatgttattatgaggtatctaggagtggttttcttcatgtttcttgtgcttttgtttcctcagttccttgggtcactggatttataatttttgttatgattgggaactttccagctatttttcttcagaaattggctgggcacagtggctcacgcctttgggaggccaagtcgggaggtgttgagtgaggcctgaaattcaagaccagcctgggtctcaacatactgagaccccattcctaataaaaataacaaagaaagaaaataaatgtttcctttcctccctgctccttctcagggactcccattactcataaattagacctcttaagtctgccctacagttcagtgataatcttttcatttaaaaaaatttcttttttctgtaagtttcattttgcatattttcaattattcatggttccatgttccctgatcatttcttctgcaacatctaatctgctgttaatcccatccaacgactttaccatctctgatagtgtggttttggcatgatatcggctcactgcaacctctgcctgcctggctcaagtgattctcctgcttcagcctcccaagtagttggtactataggcatgtgccacgatacccggccaatgttttgtattttgagtagagacaggggtttcaccatgttagccaggatcatcttcatctcctgactttgtgatctgccggattcagactcccaaagtcctaggattacagttgtgagccagtgcacctggccccttccttccttccttccttcctcccttccttccttccttccttccttcctttcatgagacagggtctcaccctgtagcccaagctggacttcagtgatgtaatcttggctcactgcaacctctgcctctcagggtgaaacgatcgtcccactgcaacctcctgactagctgggactacaggcacacaccaccatgcctggctaattatttgaaatttttttggtagagatgaggtttcatcatgttgcccagtctggtctgaaactcctgagctcaagggatcagcccaccccggcctcccaaactgctggcattacaggcacctgtttgtttgtggagaggagcagtggggagatttcaggcaggagagtaaatcaggcatctgttactcaaactttgctgggagctgaaggcatctgtttacgtgttcttagtttgacttcaacaggaggtgtgccaatttatcttccaacatatttttccaactcagtgagacagccttttccttcgtgctcttggcagctcagcaaagtttccatacaccagtctgatgtaccagtgacggggtggtgccctgcctgacttacctaagcaggaggcgcagcagaaagacatggtggacactgcccagagatactctctgataagtgttccacagctaaacctccaagatgtttagaaagtcttccaataattgtaattgttttctctggtgatctacctaactaagtccagagaaaactggctggagggaccctgagctgcttcctgtcaagaggcttatcaaataggaggggaaagaatggcttcttctagaaatttgttcctcttctcatttctttatgaattgcattctgcttttgttgaatgcaaacgatctatggactgttctccctcctagacaagggtgaattagcatgctaaaaactacctctgtgttattccttccttgacagtgtttgttttgttttgattttttgtaagactcatctcactggagacaaatctctggagccataggatcctgcacctgaccatgcttcttatgcagacctggatccttggagttattggccccctttgccttggttcttttgttgactctcttcagcaaaactgaactccaacttttacaccctaaatctggctcttggacatataggtccttttgcttcccaactcctccttgatccagccctgcctttccaacctctccatctgtgtctgtgtgcctgtgtcttgtctgtctgtctctcatactccaggctgcccccagtattacccactttcttctcctcctcttcaatgttcagggttcagcttcctctctacctacagagtcccacagactgaaggtgtttccccttacagagaggggagctcattccagaaggtgccctctagacttggaataaaccttacaaagaacacccaggtttgaaaagctttttctatcttcccattaccccaattattcaaaggactaaaagtgggaagtccagtagaattcttgatgtctctcagaaaccgacattggaatgccttcattcactgagcatatattgggtgctcactaggtgtgaatcctttctctaggtgagtagctgcatggtgtgccaatcctgccttacagagcccacatctagaggcctcaagaagagactgggcagtgggaacacaaccggcttgtgtcctccccacgagcgtttccccgttcagggacaggggacacgagcagtgagcatgacaaatgaagcacagtgaaggaaggggaagtgggtgacttcagaccaagaggctactgtggtcatgtgcagtggggccgcttctgataggggaagcgcaagaggcagtgtgggccagggagaatgtcctggatctggcattcctgcatcttgcccccactcacactgcctggtaacaatgtacccaaccacacaacttctggcctccatgtcactacgccctcaggcatctagatgcgcagcctggggatgggggcatttaataatagacagatgtctgaggcagatgtcgtcagacttccaggcacaacgtgcctcattgtggagcaattagggcagtcatcggcaaaaaactaaagactactcatcctgttccatgcaggagcatagttaaccttgtaactattcttttctgaccttcattcttccacgtccagatatatggggtctttgatgcccatctgcttcaagttagatgatgaaaatcctgcctgaaggcttaggggtttgttagaaaaataaatgctgttcgcaaaaggtgcattttaggcaaaagctcagttctggagctccagaatctacctaccccaagcccaatatacacctcctttctgtacctccatcctcgttgcacctgccttcgctgattcttcaggctgcccatctctgagaagatggcaatccctagcagaagaacaagagaaccttggacacttctgtccatgaagccgtagacgcgagcagatagccttattccttggcggtgtgactctgaagtcacaggttttctgtgcctccatttctgcattctaaaatgggcccaataggaatgcgtttctaaatgggttgttccaagtttaaataagacagggcagtaaaacattgaacccatgccctgaggcatagtaaatgctccaagagcattaaccattatcatcggtggcctcatcacggctattattatctacatccatctttgaaataattgcatatccttttagggtatggagtgatcacaacatataacatttcctaattggtgaacatttattattacaatattgctgttctttattacaaatattgctgctgggaacatatttctgcattttaatcatcacctgtgtgtttctctatcaaatcttcacacacaatttggggatgttacaaaatgtattccttcatcgggaattgaacccgggccgcacaggtgaaagcaccgaatcctagccactagaccaccaaggaagctgacccacacaaccatctccttttcagaggaaaaaagagaaggtaaagaaagatgaactttctaagagatggagcggccaactgaaagtggctgtctgtgacccaagcgggctgcaggactgcagggctccaggcagtcactgagcagctactcaacacctctcgcctctgccagcctggccgctgctttgggctgtattgaggacaggccacaaggaaactgagcaggtgttccattctagcctagctgtagcaaggtgtgaggcagagccaagcacttgctctgtttccgagcctcagtttccttgccaccgaagtgcggacttggctctcattgtgagccgaatccctctgcttcctgatctctgaactggcgcaaggggctctaccaataaagacatgtgtaggggtccccttttgcccccaactagctcaattagtagagcatgaaactgaatggatgggtctttggctcgagctccaggtgcagatttacgttcattttcttttgttccgccacacaattcgaccggttccgccactgtcctcggggcgcgaggaagccaagtgggcttcacaggaaagacctccttggtttcagagacattgtagctgtcatcttgaaatcttcagaaagaagattttggcgatagatgagaagactggaaatttctggatctaaagctaacatgaagtccacctcatctggcgcccttgtctcccgatccaactcacggatccaactcatggcgggcaaaccaggcctggttccttgtgctcagcggggtttcaggtagtaatggaactcctcccgtacttcttgtgatcaaagatgcagctagtttcccccatcccacccctcagctcccctcccctcccttaaaaaaacagaaaaagaaaaggtcattatgaaagccacctttcgtgtgagaggcgaacctgctgaccccactctagctaaacgacccgagcaccgccccttgaggacaaacccacgaaaatgttaggcgccgccttgggcaactgcgtattgctgcctgtgacagatgaaattcgactgcatctggacattcccgcggccccaggaaagtgctagcaaaaggccccggaaagcacctgcgatccctcaggtaagaagactgctgatcgcaataggcccggtctgagggttccccgcttgctcccgaaatgaagacactggagacccataaccgggctacaggatccggattcttcccgcggggtatccagttccagaactaagcgcccatgtgcgggattcgcctggctaacactctccggctcgcagaagcggcagcagccggcgggttttgagcttccgagtcccgggtgcgcaagagtgtggacgccacccctccagggctgccaagcctccagggctgccaagccgagaggctccaagccaaggggcctcatccgcgcgctctttcctcgagggccctccactcagggtgtcaacagaggtaggtcaggtgagaaacctggatttctacacacacctggcttcaacgagatggtgccactccccttcccctgcagaagcagactcagaaaaaggtagttaaaacagaaggtttcaataaaatcgagagtctggtaacataatacccaaaagtccaagtttcagttgaaaatccttcatcatagcaagaagcaggaaaatcttatgccgaatgaaaatagacagccgatacacactggcaataagatgagagaggtgttgggattgtctgacaaagattttaaagccagcaagcctgatgaaaatgatttagtaattatgagcacattcaaaacaatggacaaatagaaagccttagcaaataaatacaagacttaaaggagaaccaaatggaagtattagaggtggaaaatacaacaaccaaaataaaaagtccaacacataggctcaacagcagaatggatggtgcagagcaaagaaatccatccactacagatgaaaaaatagatattgcacaatcttaacaaggaaaaaacagactgggtgagaaggtaagcagaacctctgtgaaactacctcagaaggtctcactttcatgttgttatttatgtctggaaggggaagaggaagaggaagaggacaaggctgcaaacataaagaagtaaatggctaaaagcttcccagagttggcaagagacagaaacctacaggttcaagaagctgtgagaaccccaaatagaataaaacccaaagaggtctatggcaagccacatgaaaaaataaaatgttggaaatgaaagacaaagagaatatcttgaaagcaacacagaaaggtgacaccttacctagaaaggtaaaacaattctggggatgatcgatttctcatgagaaaccatggaggtacaatgaagttgccaggtgcttttcaagccatgaaagaaaacaattgtcaacccagactcctctctccagcagaaacatctttcagggattaaggggaagatcaaaacagtttcagattaagaaaagctaagggaatctctgaccagcagttctaccttaaaagaaaggctaaagggagttctctagacagaaaggaaatgattaaagaaggaaccttgggacatcagaaagaaaatttaaaaaaaaacaaacaaacagcaagcaaaataggccttccttcttctcttgagttttctaaactacgattgacagcttcagaaaaaaatcataccatcatttgatgtggttctaactctctgtaaaaaaaaatctttgaaataattataaactgggagggtaaagagacctacaagggaggtaactcatctatcattcattcacactggtacaacaatgacaccagtatactgtgtggtaagatagagatgcacagacatatgaatgtctggaaaaactaagagggctatgcaaacagatatactcaaaaacactatgggtaaggcaaaacaccattctgaaaaatgttcaagtcaccttaggaaggtaaggaaaagaaagcatatccagaaaacgacaccagagagaacaaacacaaaaggaaaaatataatggcagacttaagccctaccctatcaatcatcgtattaaatatcaatgatctaaatataccaattacaagacacagattggcagagtaggttaatggacgcgacacaactacatcctggctacaaagagactaccttcaaatatgatgatacaggcaagttgaaatccaaaggatgggaaaagatgtatcatgcaaaccttagacaaaggagagcaagactggttatattaatgtcagatatagtatatttcagaataaagaaactaatcagagacagagagggacaatatataatgaggaaacaaccaatccaccaactcctcccctgacaaaagtcataaatgtctatgcaacaacaattgaaattactgaacagtgaactagacaaatccacaaatatagctatatgcttcaacgtccccctttctcaacaatttatgcaataaccagacagaaaatcaacaagaatatagaagaacccaacagcatgatcaaccagtgggacttccattgacaattttagaacactcagccacaccagaatacacattgttatgggatgcattgtgcccagccaccccaaattcatatgttaaaatcagaacattagtagcaactagtgatataccaattaaaatcacaatgagaaattgctgcatacctatcagaatggccaaaagaaaagcgtaaccacatcaagtgctgtcaaggattcagagaaagctggatcactcatacattgctggtggaaatctaaatggttacagcccactctggagaatatctgtatagtttttacttttaaaactatatgtgcaactaccataccacctaggaattgtattccatgcatttatcacagaggaatagaatcttacgttcacacaaaatccatgtacttaaagtttatagcagccttgtttttaatagccaaaattgaggaaaaaatgtatagatgactttcatgaggtgaatggttaaacaaattgtgttatatatccatagcatcgcatagtcctcaataattttttttaaaaaacaacaaattattgatagccacaataacctggatgaatctccacagaattatgttgagtggacaaagggtaatcccaaaggtgacatgtaggattccacttacgtaacattcttgaaatgaataaattatatgaatggggaatagattaatagcggccaggaattaaggagggaaggaggagcagcactggagagacaggttcacggctataaaagggcaacatgaggaattgcagtgttgatggaaatgttctgtaccttgcttgtatcaatgtcaatctcctggtactgtggcatttgcaatacatttgcagtatttgcaaaaattaccattttggaaatattaccaagatgttaccattggaggaaactgagtaaagtgtacaagggacctctctttttctctctgagttcttaagattgtatgtgaattattaaaatgtaaaaattaacttaaaaaaatcctaagtatatttctccttgactgatcatgcctttgcttaaaaacattaaggcaacaatatttttcccaacaccctttattttcttgaagactgttttaacaaaagctgttcttagggcttttcctaaaagtttaaaacttctagtaatccttactgttcttctttgagaaccgtccagggttttgttttatttatttattttacacctttcaaaagaataaagacaaaaactggcaactggcatataatactatattagtcttagtcctccagagaaagaaatgagcaggatacacacacacacatacacacacacacacacacacacacacacacacacacagaagcagagaagcccaagttctactctgagtaagctctagaccgaggagagtcaaatatagttcaagaccaagtccaagacttaaggcagaagattgatgtcctagctcaaagacagtggagaagaaaaacttctttcttaacccttcatcctattcaagccgtccatgggttggatgaggtccactcacacccaggagggcaatctgcttcactgagtttactgattgaaatgtcaatctcttccaggaacaccctcagagacacagtgagaaatcatgtctaaccaaatatctgggcaccctctggcccagtcaaattgccacaaaaattaaccttcacaaaaactctcaatagaagttactaataaatgtagcatcatgtcctgcctgtttatcccatgacaattaatatactccagcgtaacattggcttctgttcccttactgtagcaacacataggagtttcatttaaagtgaggataatttttaccttatgaagtctctccctacccatacataccattgccacttgtggattgtcattttgccatggctttcttatacaaaatatcaacaggctatatactttgaaaatgtaagtttgaatttcatcttggctgcataagtcactttccattttgacaaggcctagatatatttttatctcccgaatatcggtaatgcatacctattttggggcccactcccaatctcacagttttctttgttttcatttagatctcaatagatatgcctaggctgctggaatgtcactgaaaatggcccgtggccttgtccatctatcagagtccagtaaaatcttgaccatgggatgggggaatggaaaatgagaacaaccaaactcagcacacaaagactcagtttaaacctctgtgctaagagttgatcagactctatcatgacttctaatagcataagaccatatcctgtgtatgaccctcggctcccatggcaatgcctgcctaagaaagctcaaggctgccaggggaacttactttagttctagccaatacctgctgatgatggtaggttctttcttatagcacttactaagaagggaatccttcctccatccctttgagatatgtgtgtatctcctagggactccagtgtgtcttttcccaggatctgaaagccattcctttgaggtatagtcctcaggaaggactgagtctctgtcttccggtctctgtgggaggttagaatcctaatgtctaatattgccagctggcagacacagctgtcttgatgaggcagaagcttacaatgactaatcttttgtaatgtttcacttgtgctgtgccctctcccctgcctcactctctgtttagaatgccatcacctctgcacaaatgcgatggagctcagccccttcctctatggtcaatagttactgaagaaaatctgttttcacagctttgactaatgtctgactttatctttgacaaaataagtgtgaccaattgtttttagcggcacggcagctgcaaagagaggcacagacatggtgggagagggaggaatcatctgacccttctcatttcataggcatctattactgcctggtatttatgagcccgagacttggctgggctgccctggtgtatcactccatggctctgaggcaggacttgaataggctggtggtgacacttggtgtgaccatagccaccttcaaagatgccattaagggttcactagaaaatgaaaggaaacatagaaaaactgattttgaaagttgttgcctctcccacttcctcatacagagtgtgtatgatattgctgtgtgatgttagttggactgcaatttagcacaacagctgttctaataattggtagtttctcatcgagttaagcctacctgaaaaggaagcacacttacctttattgattacccccattaaatgaacaatacatccaaaaatgttcttattaacctcatttttctactaaggaaaaactgggaataacacaaatcttcatcaacagaaggatttaatactgactgttatacagccataaaacaatcccagaagttcactcaataacatcaaaaccagaaatccacactgatgccactgatggcagaaaatcatgatacaaaaatgagaaagaggagagagaaaaaatgtactatagccagagtagtgggtaaaagccaaagagctcagtttctactcatgatattcagtagaagaaccgaaggaacatgagccaatagctctaagggtccaggtctgcacaaggtgcctgttgggtgcagggttctgttggctccaatgatgtatcgcaaatgggctaatttttatggacatagccacagcagaaatctatcaaagaataataaagggatagctatttgcatgttaatttaccactgtataggagggagaatgggcattacattggtttggtcaaacaaaagcaaaaccaagatttatgaagaaaagaggaaaggggagaagaaaaaattatctgggacctttgtgattttgctccccttgtataagcgacttggcagaaagctgacaaagaggtcactgtggcccatcttctccggacccacgtgacttggtcaccacagaaaacaattacagatattggaggactttaaaacatcctagaagtttagcagctcatcctaagccgcagaatatctgtgcgtaatgtccaccatttccttcggttgtacaccccctcagttaagccaggaggatgcctctcttctcagtggaatatcatacatcaatgtgtagaaacgtttgttgtgccggcaagtaaatgacagaagggacattgatagaattgggaaacaaattggaatatgatttggtatcgctcccacggaagataaatttgcagaatgtactcaaattagaagcattaaataaatgttgtaatgtaaaaatggcacatcctcctctctacactatagaaatatctgcacaagtgtccaaagatatgtgtacaagaatagtggagattgcggcatcatttgtaatcctaaagccatgaaacccacctcatttcaaaaacatcttgaaaagggttaaatcatgcacaaacagaggaagaaatgctgttttcacaaacaatggcgaggatcaccatgaggatgactgattccactggtcacattattgatagaggaattacttaaacccaggcacatccggggacagaatactactgtaataggtctcctattattaaacatgaaaaactagaggcactttactcccccaagtcttccatgggagcaaagaacatttttatcacaccagaagtgagttcctgtctaaggtctctgggattcttgagtttgacaggtacaaggcaccatgggccttgccaagcctcagacctaagaaggtggggaagaggacatgtgtgtctcctgattaggctggagttgattgtatatcaacagaaatgggttaaaacaacaaagcgaggagtccctggttgggctcggaccaccagcctttctgttaacagccaaacgcgctgattgcgcaacagagaccgctgctactgattctaccgagcgctacatgcagggcacactcaccaaactctccccatcccttttgtcctgagggcctgcccctcaggagggaaaaccggagacattagagcggtgagtcgcgctgatcacgttgcacacccgcgggttgggagattctggagccagaaggacagccgaatggccttcgcccgccctgcccctcgcctgcttcagaagcccccggaaacgccccagtctgcgacccgggcccgagccgcctgggggcccaagggaagctgaatgcccggtgggctcccaggatggctcttccagttcttcgcgccgccttcaccccgtgagggagcctgtgcccacactgcccagtcgctttaggggccgctgcagagcttccgctgccatcttcggatcctgtgtccgcaggcgggctccaccagggcagggatggtggtgagagttcctcgtggtcccctcgcggggagcagggtctgccattcaccagggcgcaggactaagactcgtcgagtgaatccattgtcgcctttaacttttagtcctttgaagagtcctgagaatgtaaatcatgaactatttttctgtggggaagttttgttttgttttgttttgcgacagggtctcacttggtcccccaggctggagtgcagtggtgcaaacaaggctcactgcagcctcgacctcccggggccaagtgatcttcttgcctcagcccccaagtagctgagacgacaggcgagcgccaccacgcccggctaatttttgtattttttgtagatacaggatttcgacatgttgccggggctcgtcacgaaggggaagtaggttctttttaaaaagcattttttccgattgctttatcgggcatcctgtggggcgcgcaagcggcgaggcctccagtggcctctcttgccactcttaggcagggagctgcggggactcagctgcactgtttttgggtgcctgtcttgcgcaggaggccggagccgggcaaggggtgaatccaacagggaattgcgaggaggagggcaaggaagtcggtagaggcgtggaccaggaagaagaaactttccagtagctttgtgcagcggtaaggactgcacaagggagagatgagaagtgttttttttattgtagcagaatggggaagaaaggggggaaaaacggagagacaccaagaacgaacgaaatctacgcggacccttaggtctccaaaaaggaagcagccctgcattacgtttaaacaaagagcccagcgcccttcagctcctgtggcttgcggtgatcgtattgtggttagtactctgcgctgtggccccagcagccttgtctccaatccgagtcatggccacatccattctagggtgtagtgctcttctttccctttcgcctccagtctcagcctaggctgagcctctgacctgcggctagaaaggtcacaactttcctgtggcttaggaactcccggtagtgttgagaatagaaggaacccctaccctgcatgcctaggggtccggttatcttgaaagacttttgcctcctctctgagcaagtacaacacccaaaagatgagatgctccctctcagtcagccttattggaatcttttactgttgacatgatatggctgtacccgctgttctgactcagatatttcaagaatccgtggggccttttcaggccaaatcagaaatgaacaagagaagatgagagttcacactccaactgggtattttaagtaaaacctaacgaatacagtaaaatctaaagttaatgacattctccaaccccaatttttaattttgtttttatttatttattttttgctaccaataaatgactgaagtataatccgcagagaccaaagtgcaccaatcttaagtgcatggcccagtacattttgacaaaaaaaaaccatcacctagatcaagttacagcacattttcaacagaccaaaaggtcgtgagaaccccttttcagtcaatcttcaccccatccccacttaggcaatcactatttgatttctatctctgtggtatacttttacttcttgtagaaatcacgtaaaggactatactgattttgcctgtgtttttctttttttaaatgcaacaattgttatgagatgcttccattttatgacatgtatctcagctctttgctgttattaatgagtgttattccaacatgtgagtatactacagttgatagacaattgggatatttctagtttgggctattgtgaataaggtgtttacaaatattctattatgggtctctttatgggcctgtgccttcaattctgttgagcatgaacccagcaatggaatggctgggtcatgaagtgggtgtatttttaactgtattagaaactatcagacagtattttagaatggtggcactattgtattctcttttattttgttttgttttattttattttatttttgagatggtctcactttgtcacccaggctggagtgcaattgtacaatctctgctcactacaacctctgcctcccgggttcaagcaattctcctacttcaacctcaacctcccaagtaactgggattacaggtgcctgtcaccacgcccagctaatttttgtatttttagtagagatggggttgcaccacattggccaggctgatctcaaactcctgacctcaagtgatccacctagctcggcctcccaaagtgctgggatctcaggcgtgagccaccactcccaccaatactattgcattctcttgccagcaacaagagttacagttgctctgcatttttataagccagtggctttccctgtctcttaaatgttacccattctgatgagtgtgttatggagtatcatggcattttaaatttgtgtttcctgaatgagtaataatgccaagaatcctttcttatgcaatttggccattaagaaattctctttggtaaacaaacactgttcaagtgttttgcccattttacattggcttgactcttttcttcctccccacatttatacacaaacttttctatttgaatagaaaagttgagaagatagtacacagaatggagtaaagaggatggaatgggtttttggaaaccaattcacactttaaagttgttttaacatcctccatccccaaagaacaatgtatgttttctgaagacatctccttattgaaatatgcagagaaagtgtgagataaaagagcatatactaaactcctcagaacgtgtttctggaagtggacagggaaatgggagtgggataaacaaagaaaagaaggaaagacagtaagggccttgctcaaagcagccaccataatgtgccctgagctaaggtacatgattaccttctccctgtgcacctgagatctaagaaaacatattaactaatcagggacatggatttcaaaaacactacagaaaaacagaaaatttacccagacagaccagtctagttaagaaaggcaggaagagattttataaacaaagcaaaaatgcagaaatcatacaatgaggtggtgggaatgagacgtcatctccaatataatactaattgctgcaaattacaatgcacttaagtctctcagatgggatagaaaaggaaatgccagctctaatggtttaatgggcagaaaagggtaaaatattcaaagaagtgcacattattatatatatgtatatatgtgtatatatatgtatatatgtatatatatgtatatatatatacatatatatataatttttttttgagatgcagtctagctctgtcaccaggctggagtgcagtggcacattttcagctcactgcaacctctacctcctacgttcaagtgattcttctgcctcagcctcctgagttgctgggactacagtcacaagccaccatgcccagctaatttttgtatttttagtagagacagggtttcaccatactggccaggctggtctcgaactcttgacctcatgatccacccacctccgcctcccaaagtgctgagatcagacatgtgaatgactgcgccaggtcaaaagcagtgcacattatcttagcaagctaatgcagaaacaggaaaccaaacactgaagtttttatcgtttcttaaaggccaagtgtgaactattgtgacagcttagtctgagagttccagatacatagcatggtttttgcccatttgctgggtctttcctctcacatcctaagtgctgaaaagacacatgtggcagggaaagagagtttcttgagcttgccacagtggtggaggcatataggtcatgattggccaccactagagtacaggcacaaaatctggttgcttctctcacatgaaacaaaaggcatctaccactgatgttggagcaaggaacccttccaaccctggcctatagctggccccaggtataggccagctgctgaggtagagttagacacaaaagctgtctatactggacaagggaagacttgcaatcaatcatttgagttggttgcagaccctttcctttaatgaggaaaaactgtgatgtgggtacaaagttccaacatccagaaagattggccttgtccttaaggatattatgttgattggatttctctcaacctccttcagttgtgtttagcattattaaaattaagtgacattcacttggatgaagtggtaataaaaacaagctgtgagaatttctagtgatttttgataccaagccttgtatcactgttgggctttcatgtgtgtacttgaaaacaaaacatgtaaattgttgcactggtttgaagattttaatggtgaaagcaacctaatcagttatgagtaccacatcgagaaaccaaccttggaaatatgtgattatgctcttttaaaatagctgaaaagaaagatgggtgtggtggctcattcttataatttcagcactttgggaggctgagtcaggcagatcactgaaggacaggagttcaaggcctggccaacatggcaaaacatctttactaaaaacacaaaaatcagctgggcatggtggtacacagctgtaattccagttactcaggaggctgaggcaggagaatcctttgaacctggaacttgaaggcagaggttgcagtgagctgagatcctgccactgtaccccaacctgggtgacagagggagattctgtctcaaaataaataaataaataaaatagccaaaaaaacctgactgtgtgtttattctcactttgttcttgttttgttgtataatatttaaataaaaggagattatttatcctcatactgaatttccaaaactgatatttgcatttagtattttgttaaatgatggagagaaaatttaattgtcttactttgaaaagtttggcataggttctgtcacatttttgatgctttcggtcacagttctgtcattagaatgctggcaattagttacatgcaaggagtatcctaaccactttaatacgatggtttgaagtgctgcaggcagtaactactggacagcagatcatagtgtttttatcggtgacacgttagagagaaatagaactttctgcagtacaaatgtcctattaactaatccttatgctattagcttacagggctttgtctcctgggtctgaaaaaggcagcttctcctgctaaatcctgaatattgacaccaattaatgccttgtcttcagactctggggaagatgacaaacaaaatgaactgctttcacaagacacagaaccagaaattgaaaccattcaatccctttaggcccaacaatcccacatgtcccgttttccacctcatgccccctcttcctctagacagaagaggtgggcacgtgagaattgtaaggctggagtttgagggataagtttagttcagagactttcttttctttccctttctttcttttcttttctttcttctttctttcttttttttttttttttttgtatttttggtagacacaatgtttcaccatattgcccaggctagactcaaactcctaagttcaagtgatccacgcactctggcctctcaaattcagagattttctataaattagacattacagtcaggagcacactgatgcaaggccaacatctgggctcgtgtattgcaatatcagggttttctagagcatttatctactccttaatacaaaagtataaaaggttatgaaaggtttttggaactcttacctcatggtcaaactgacttttttttttaatgcctccttataatctttttaccaaaggtatattttagttttcttatacaccttgcacataaactgtttctttaatagtactcaggaggccttattacttttaaattatacaactttgtttgcataaaatttttttataactttttttctttcacgacttccgcagacaatttttcaacatgtctcaactttctgacttattacaaacacttttttctttaaacaaccagttaatttatttcaggacaagaatttaccacataactttttgtttgtataaattctgcttcctccttttttttccttttttaaagtgaactttctttatgtctttggatagactgtctaaggccacaagattagaagttaccataatacatgttacactgttaacttttagcaaacttcacttttgtagaaaaccttgtaagtttgggatttcaattgtcctttgctattaataagaccttgtttagtctaaattaacttagaattggtatagatggcctctttttctctctgatggtctttacttgcctctgccagctgcttatgctgctgttctcttaactactgcgggcagggaaagggggtctaaaaccagctgtaactgtccatgtacggaaactggtctgggtgccttggcttagaggttaccttatgccatacctttgaaacaagggacctgtccaggcttccttctgatggccaacctacatctaatgctggccagtctatttcacataaagttctaagtttttctggagtcatagtgactccatagtctccattgaatcctttcttgaaattttttaacatagttcctagtggggggggcttatttgtgcctgacccatgtttcttcaagacaaaacaccacgctcacaccacacgccacacaccacaaaacaaaaaacaggtaaaaagggcacacacacacttctgcagtttacaccaaaccaaaatcaaaaccaaaatcagagtatccagaaatccaagccaggtcaaaaccaaaaccgaagtatcaggcaatctaagtcaagtcaaaaacaaaaaccaaagtgccggtacaggcacactgtgggtgatcaggccacgcttccactcaaatggagtaggcaagttcccaagaccagtcctgtcaagcaatttaaaccaagtcaaaaccaaatccaaagtgccaataaaggcacgctgtgggtgatcaggccacgcttctactcagatggaatgggcaagttcccaagactagtcctgtcaagcaattcaaaccaagtcaaaaccaaaaccaaactgctaataaaggcacgccgtggttccactcaaatggagtgggcaagttccaaagactagtcttaccaagtttcagatgtccggactccaagtgccagttccttcccggtgttcagccactgtgttaatcctccgcgggggcctgctacgcattgctctggcaaggcgttccaccggggcaattgcctaccccgaagcgctctttggatcatgtcactcaggctggccgaagtctcccgcagagacgctgcacagcgcaggcttaagccgcctaaggggctgccttggcagtctgtcagtcacctcgcttcccagtcagggaaccaagaaaggtagcaggatgagtcgcaaacaaaacctctcagacacggagttgtagaaggaagggctttattcagctgggagcatcggcaagctactgccttaaaatccgagctctggtcaaactgattataattaaacttgtgtataaggttttattaaaattagctttaacattttaatacaccacacaaaggtaaaatttggttttctcttttgatcaaaatgtttgtgtagtattaataatagataaaatatttttgtttactttcaaagtaaactgcagggcaaaagaaggaaggggagagacacatacacatggcctcatgttgtcttcattagctcttactgtttagaaaactcagcctcttttctagcaaagggtgaacatttttgttttatcattttggctaaatgattgactatactaaggtgacctgtgatcctattttgtgatgtcaagtgtctcaaaactttgatatctggcaaactttctaagagtaaagtttctaaattcaaccctttgggcctcaaattaactttttggatattaggttcttgaagtccaagagagatatattaggcttcttagacttatttgttatgtagaattatgcaaggagcattgtcaaatctgaggtggtgtttcacttcctttgggttctattgacacagatgtgttgttaatgtgtgttccaggattgtatgagattcctagagttctgctatgctgtcagtaataattatgattattatgttaaattgttgtgtgccacagaaacaacagaattcccttgtcaattgtatctataactatggctgtcttaaggcttttgtcatccacaattgttgttttgctttgattcttcttaaaaagtgacttataatcagttacagtccaggcctttcttctttggggaagtccatgaaaaggactcttggatgcaggactcttctgataactttggagattgtgccactgaagtaaagagaaaatttccagggcactaatagaaagacggatgtgttcatagagattgctaccccaatgtgacgcagagcaggagttgattgcatggattgaactaatagaggactgaaataagtttttatggcctttgtttgtttcaaacattgttgattcttcagagtctggagaacttgtttccttttgagctatttatagactgcaacaattgagtagaatcgtcttctaaatagaatttgaggcatattgttctctctctgacgaatttctacagaatttgtaaactgaatattcttaactcatgacaatgtgtttgtttgcatgagttcaataagattctgttttcttttataatgggacacaagtggaggaactggtaattttcccagggctttgcctgaaatggtgttgtgaaatattccagcaaagcctatttaggagagcctatatgaacaaggattcttgctgcactttgtgtgggtaatcaggccaagtatatgggactgaagcttcttttgcaggtaggttggtcctgctgtgttttgtctttagtggaagtgagggactggagagaggaagattgtgtttcaggagaaactacagtattagatgaatgtttgattcctgggtggccatgcagtcacccatggtgtggagctgctcaggatgcccctcctccacatgatgcagccagaaagatggatgatcagattccccatgattgaggaactgacaaatagaaagtggggactgaaatcaacccaagagtcccacagacagtgtttttggatagacatagaaatggacccttctggtcttaaagcttgaaacttaggacatttgttttatctgagttccttcctcagcaaaggcctctcaggcctctcaaaaagcgtcatagacctgaaactcagcagatgacagcctccagacaatgagatgccagacccctcactcatcatgagtgcttcctcacccttccctagttcctcttttcccacccacagttaacatttcttccctgctacataaacccctcactttagttgatcagggagattgatttgaaactgatcttccatctcctcagctgcagcacccaattaaagccttcttcctcagcaatactcaatgtctcagtgattggctttctgtgagctgagtagcagggcctagaccgaactcccgggctttcagtagcaatacatgtacacttttaaagactgtaattaatgggtcatgatatattgacaaattgtaatggtatcaacttggccaattctgagaaaatacactgtgcttcaatatcagggccctgctcctgacctcgacagtatatggctgattttgagtcatagtaggagagtatggcctggtttgagtgttttatagaaatgtaaacatggctgattgcttttattttaaatccaacaaatctccatttctggtgagaaaattttgttaaaaccaaccaaccaacgaaacatagaagaatatgaataaaaaaataaaggattccctgcttcccaatctcacttgattgctgtcttctattatatgctacagggaggaagggggcaaagtgcccaggaagtcccatgtcctgttttgacaatcatctggcctccttgggcaaatggaaaagagggaaagcatcaagaaaataacagaaattttgcagatatttcatctccgggctgggtgcggtggctcacacctgtaatctgagcacttcgggaggccaaggcaggcaaatcacttgaggtcaagagttcaaaaccagcctggccaacatggcgaaacctcatctctagtaaacatacaaaaattagctggacatggtggcccacacttgtaatcccagccactggggattacaatcacttgaacccgacagatggaggttgcagtgaggggagattgcccactgccactgcactgcactccagcctgagcaacagaaggagactctatctcaatgaaaagaaagatgaaaagaaagaaagagaaggaaggaaggaaagaaagaaagagaaagaaaggaaggaaggaaggaaagaaagaaagagagaaatttcatctcgacacaggaaactctgacctaggctttaaggaaagaaaagaaagaaagaaagacagaaagagagacaaagaaagaaagaaagaaaaagaaagggagggagggaaaggaaagaaggaaggaaggaaggaaggaaggaaggaaggaaggaaggaaggaaggaaggaaggaatgaatttcacctcaaaacaggacccagactgtgtcggtcctgaagcctctgtgaccgaggcttcaagggctcttctctggccctaaatccacagtggattttgccttattttccgaggtgcacatgaaatgatagaagtcgatcaaaggagagggcagagagaaagcaagagggctgggtccttcctgcaggtccaccttcctcaggtattgcttgtgggatcaaaagaaatgccttgacatgggtgggtgggaactattgatacttattaggaatccacacacctgcagaaaacttgcattgtgaggttccatggtgtaatggtaagcactctggactctgaatccagccatctgagttcgagtctctgtggaacctttctgtgtaactgggacgataatgccgtcttttactccctaaatggaatggggattccgctgacgttcttcagaagctctgcgctgcgggcctccgtgtcccttctactcccgctgtctgaaccccgcgatgtcccccgcgctgttcgtcccctcttcgtctccctcttcgatgttccgggtcccagaaaccaggttatcacagtggcccggatcatagggaaattgcgaaatcatccagttgggatcaccgagcctgcagggtccccttcctgggcgagcctcctggccccgtgctatcggaggcctggacacccccgccagggacccagcgacccagcaagtccccaccccctctaagggcgacctgggcctcggggtgagaggtctcctacactaaaaaggctgccgcccttcaatcctagaccccgagattcctttcactcgggaaatctcgtaatggcatccattgtcattttggtaagtaaatggcgtgagaaaatttgatggggttagctcagtcattggaaattgtgtctcagtttacgatcgatggtttgagacctaacttgggagtagcactgttttattcagatggcccatcctattccgaatgttaatttgctctgttcttcatattcagatctttatgccgaatttctagctcctgcgtctccattgccggtcctaaaagtcgccgtttcactaagcttcggaacctgactccgagaaatctattcgttcgtcccaagatctcagccagaaagagaaatccgcgcggcggcctcttctagctcgggtgctgggaggccccgtcctgatcctctgtcgccctggccgatctccctcagggccacggggaagaggaacctgagcagctctgaggggcgagtctctgacggtggggctccccctcgtcctgccaggaccctgccccaaggagaagaccccttaggacgttaccagatttaaacaatgttttctcctgctcttcagagcacctgggataaggttcctgatgggtcttgggagcaaactaacatgtcgctccaggcgctcaagaccatccctctgattttcatattttggggctgagagcgtttaagaaggactgaaaaacgctgcagtctttgaggggctaagtttggaggatgcgggagtgggagaggatgccttcttggctccttggagtggactggcaggtaaggaaacacaaactccgtttccccttgcaggctggactgcagggcctgggatggaaaattggaccgtcaaagagtaacagtatttatgtagaggttggctgcattcattaaaaattgttatccctacagataagtgtaggaagggaccagggcactgccgttcaccaccagctttgcagcatatgtgactttgaaaacagtgtatagtgcataaaaattcatccctctttacaaataattgatcacaaccagttacagatttttttgttccttctccacttccactgcttcacttgactagccttataggaaaaaaagttatttgtaaatatgatattgtttcagttgatcctcagcccgcccgttccccaccccctgaaagtagctggaacaacaggtgtgcaccgtgtgctgggctcatttttgtatttttagtaaggattgccttttgccatattgtccaggcagctctcgaatgcctggactcaagtgatccgcctgcctgggccttcctgctcctccctgctgggattacagctgtgaaccaccccacttggccatcaattgtattttgaatttaaatgttttatagtcatcattcttcaaatattcttggttttgttgcatgtgcatgatggggttcaggacatgctaccccaaaatataacatcttggggtattgaatattttatgttaagggaatttgaataaacaatagaagcaggaaggtcactgtcaccctccccctgcccttctttcctgaagtcgattatagacccttatgtgagatgtgccctctctgtacccagaggaaaggtgcatcctggagtctgaagacacagggacacagagaagagcctgaacacagaggcctggccccgttttccccagtttgttactgttagatcatacttttattgtcttatcatacttctccatgactatccattcttcaataaaactactcttaaaaaacaaacaaacaaacaaaaaactgaggtttagctgtttccatgggccttcatttcctttggaaggcattcctgtcatgtaaaacttacattaaataaatacatctgctcttctcttattagtctgtcttttgctgtgagggtctcagcagtgaacctaggctgggtgaggaaaagtcatatttcctccccgacatgtacaaatgtctttgactgtaaaactataagaattttactggggcagatttgaagcaagaaattgcatcattattcccctttggatgagctgaacagatgagctaataaactcccagttccccccagatagaaatacttctctagctcattccctgaagctcctagagggtcaaacctgctggagattaaggggccttcctgggatctcccagcccaggaggttactgctggtgagaggattgctgcagtctccctgggagggtgcatggccattggaaagtatcactgctgtaacttcagtacaactggttttcatcacatctgctctttgtgcagtgttgcaggcaaaatacaagagctaacatgcacatgagaaacacatgcacatcatcaactgtgcctgcaacacaaagtgccacatgtcaggcacagttgatgagtgtgcatatgtttactcatttagtccttacctcaggccgaggtcacatcatcaccttcatcttccatatgagaaaactgagatgcacaaagatgttaagtgacctgtccagggtcactcagccagcaaagaagaatttgaaagcaggaatttgaagtgaagacagcctggctccagaagacattctcagaaccactgtgtttatactgctcctaacaaaatcacccttgcaaaaattatgacagtgagaaaaacctgacataggaaaactatgactgtgaaagaaatctgacctaactgactgcatcttgcttctaatctctgagctgcccttgtccattcctgggaataggccaggctaactatgagaggagtttagtttagtctaactctgaaacaaagatgattgtcgctcctgagacaaaccccttcctttcttggggatcagacctccttagcaaagctaacaaattaggcacgagattggaatttatggctcaggagccgtgcagccagaagtcacatgattcctaagctccccaattgtgcctatatatagtattattagtgtcaaacctaatattggtgtttaagatatttttcagaccctgccttgtgatggactagctggtaccactcagactggtaaactggctcatctggtcctgtggccccatccagggactgactcagtgcaagtaaacaagctcttacaccctgtgatttccaaccaatcagctttgcacattccctagccccctgcctgccaaactatccttaaaaaacaaaaaaccaaaaaccaaaaaccaaaaccaaaacaaaacaaaaaccctagtctctgaattttgggggaggcagatttgagtaataataaacccctgtcctggtccctcagctgcatctgcatttgttaaattctttctctattgtggaaagcctgctgttctcagctccattggcttatctgggcaatgggcagaataaacttaccaggcagttacactaataaaagagaaacacaaattgtaagcatgcttcaaaagaaatgttaagtctttgtatttcttttaaagaaacacaaaaggaggaggaatgataagacaggcaatacactgtcctaaatattttcatgattctcctgcctccttcatatccttcttatcccaacaacttctccccagaaaccttcaacttaaacatggtcctgccagaactgggtttgtccttcccttaacattttcctctcacctgccctacaccccttccaaatctaatctgttcattcacttccaggtcattgaggattttccatttaaaaatataaaaaattcataaagaggaagataactggtcatccatattcacacctcctggaattaactactgttaacatatctacatatttttcttctgaatcatttttaagctattgtctttttttaaaaaaatttatacatgctaagcatagaccgtactaacagtagagaaaatgtaaacatatgtaaaatttttgatcaccttaagttcaaaaataacttctcataacattcgggcaacactggagtcatggtattgtgttatatctacagagagaagaaagtatattttagctagactgttccccccaggccccacaaaagaaaaaagaagaaaaaaaataaagaaggatatatatgcctgaaaaaattataaaattataaaaatatataaaatatatatttaatatataaaattatatagtatatataattctatatttaaaatataaaaatatataaaaacatatatgtatgcttttataaaattgagcttagactctatttttattttacaaatattccacttaatagtgcatgaacttaactgcagacaaagagacagaaacagaaatgaaggaattcctgaactccctagcacagttagaaagacatttgtctaaacgactcctctaagggcaaacatacattaaattaaggagaagacattaagatttggagtggttttcttattcctttttacaaccaagttaaggtgtgagttgcctatggtacaatgcatccatttcaagtttgatgactattactctaaaaggtcctcttgtgccctttgcagtcagtcccgccctccccctggccccagcaattaatgatgtattttctgtcactatacaggttagttttacctgttctagaaattcaccttgatggcgccacacaggatgccctcttttcatcactcggcatgatgtttttgaggtaatccatgctatctcatgtttctgtaatgtgtcccattttattgctgggtagttggggtagatcgccgacacattctgccgacaagtcagactgcggttctgacctgaaggcctcggtgaacataagcaagggcacctgggcgcggggagagccgttcccctacagaaagcaagcgtgttgtgtctacaaccgaacagggacactgctttcatcccaaagaacagcacccgtctgcctagaatttctacctggctctaggaggtgagaacacattccccgctagcacagaaatcctacaaacttctgtgggggctgcggttagaagcacaggctgtgtgaaaggtgactccgggggctacgaaaaaacacgaaggttttcacatagggtgagaacccaagacactggagaccatgaagcaatcttgaaaaagcagccccacgtggaaagggaagagaagagcactggggccacttagcttgcgttaagcaagctcatgataggggcggagaggacagtaacacaatactttctctttcttatgcttgcgactgtaggacaacacttaacatgccagcaaagctacaaacccgtagaaagctaagtagaaactaagagtagcccttcctgcagaattcactttttgcactgcaagatttcagcggaaagcactaacgcagttctccactgttattgtgcagccaaatttctcccatttgggttaatcgcaggatcagcacgtccacagtgcaatggaaaagcaacgccctgggaaaacaaccttcataacgtcctctgcgatgtcaggtaattaggagttcacacgtttccgtcttgctactgctccacacgcctcaccctttttacacacggtcacttgccccgcgcaccccggagcccttccagccttgacacacagctgggactttcaggtctgaacagcggtcctggacttgctcccacagcacgggaactccttcgtagcgaagcagccggtggcgaagcagcagcccctgtgctgcctcatctacatagaagtcgccctatccgtgatgtcactgacagcgcctttcccgtccggctctgcttttccgccccaccttctgccactcagccgaccaacatgctgccagagactgcggggacagtgacgtctgcctttccttcctttccctcccttccccgccccaatctttccaaagaagcaggtgtttctgttgtagttttttgttttgagccgcagtctcgctctgtcgcccaggctggagtgcagtcgcatcatctctgcttcctgcaacctccgcctccagggttgaagcgattctcctgcctcaggcttctgcgtagctgggattacaggagcacaccaccaagccctgctaatttttgtatttttagtagagacggggtttcaccatgttggccaggctgatctcgaactcctgacctcaggtgatccgcccgcctcggcctcccaaagtgctgggattacaggctgagccatcatgcccgcccagaagccggttcttagcctgtgttgccgatgacctctttggcagacagctggaggctgtccacccttcttcaaataatggtttgtaatgcgcagactaaaacatgtaggattacacaagaaactggttctcttcccatcgttattcttctgatgtagcattctacttgaaattggaagccgttcagtatcagagagaaaccatatctatgaaactagagatgctgctcagatgactgcaaaccagccatccttacttgttttaccattagtagtgctataaagacggtggtccaatttcatgaatcttgtaggattttttcaaatacagcaatgtacaaatatgctgccccagcagagcacactggacactcgggcatggtgctggagtttgtcatctcttccatggccttctgtagaccgtagcacttacctcatgttagcactttatattctgcaaagagagaaacaagtggtccaaatttggagaaaaaaaattgggggaaattttatttgaggtgcttaactgattacttttaatttgtagaatacaatcccaaactctgacaatactccacagactccaaatctatcaggcaagtttttcctgtcctttgctttcatataaatcaaatcataaagtgtgtagtgggttttgggggagtataactgcgcagtgggttcctgttgcctgctgcctagacagaaccaatttatcaagacaggggaattgcaataaagaaagttgtttacccagagctggctgtgtgggagaccagagttttattattactcaaatcagtcttcctgagcattctaggaccagagtttttagggataatttggtgggtgggggacagtgagttgggagttctgattggacaggtcagagatgaactcacagggagctaaagcatgctcttgagctgggtcatttcctgggtgggggccacaggatcagatgagctggtttatccatctgggtggtgccagctgatgcatcgagtgcagggctacaaaatatctcacaaaccgatcttaggttttacaatggtgatgtgatccccaggaacaacttggggaggtttagaatcttgtaagctagaggctgcatgatcctaaaccatgatttataatcttgtggctaatttgttagtcctgcaaaggcagcctagtccccaggcaggaagggggtttgttttgggaaagagctgttatcatctttgtttcacagctaaaccataaactaagttcctctcaaagttattttggcctgtgcccaggaaagaacaaagacagcttggatgttagaagcaagacggaagcagttaggtcagatctcttttgctgtgataattgtcccagttataattttttcaaagtcggtctcaggagcagaggcataggtttgatttctttcactcagtcttacatctatgaatttttcatgttactcatgtggttatttgtttctgtgcacaatcctttgtatgaatatcggccaacttatctatttattctactgttgctgaacatgttgacctaaaagaaagaggctgaatcacaaaatagaatctagagtttacttgagccaatgtgaagacagctgcctggaagactcacacccaaagaaccttggatctgagctccctttggcctttgtcacaagcaggtttttaaaagtcaaaagggggggatgcacaatgggctgatagaaaggtgcccgtcaggaattctcattggctttcagaaatagcattgatgagagcttggctatcccttgttatagggtgtgggatacagtgtttggtgtggcattattagattaatttacagctacctggggtgatagcaagcagtttcaacagatgaatacatagctcaaaaagaaggaagcagaaagtggttgctgtcttgatttaatgtctctctgatcatgtgaagtggctcacattcctcagataaaaattctttaaaaaatctttcttcttgaaagcattgatgatcaaaagctcagccaacgtgtccctctttgccaggaaagctcattcccagatagtctttcccacggtgagggcaggggaggaaaggagctgcctcactgaggaatttttaagagcacccaaaagcccaattgaaagggtgacaccgagtagaaaaaaaagaaaaagagaagaaaagaaaaaaaggaggagagagagacctcagttaagtctgcagctatcactcgttgaatcatttctagtcttcagataccataaaatcagttttctcagaagcaggaaatatatagcattaattatttgaatagtacacatataattcacacaagaatgagaatcacaaagagaatctgtatgccagaacagtaagggaacctattccattagggagccaacgaaaaacatcagggaaaacatcacatcccagttcttctttcatgatttcttgtagccaaatgacttctaattttttctagatgaggttctacttcatgggaagtatttatttatgtatatgcaacaagaggttgtaaacaccacacatccacctccctgctcagctaaatctatcatctaaagcgggctgcggaggctgctgttgctggggctctccccttggtgttctgggctgcgttgtactaagtggagaaggtggttgtgggcaagcgttgtgcatagatcacaaccaggtgggcagggggctgctctctccacactatcagttgacaatgtacaattccttttatgaactcttgtaagtgctgctgtatctacccattgtttttgttttgtttttatttttttgagacagagtctctctctgtctcccaggctggagtgcagtggcacgatctcggctcactgcagcctctgcctcctgggttcaagcgattctcctgccacagcctctcaagttgctaggactacaggaagatgccactgtgcccagctaatttttgtatttttagtagggacggggtttcaccctgttggacaggctgatctcaaactcctgacctcaggtgatccacccacctcagctgcccaaaatgctggcattacaggcatgagccacctagcccaggttctacccatttttaaataaggctaatagtgtctttgaaaatatacatcatctaaagtgacgcgattatctagtacaaccttagccagtgaatgaatagctttttgatgagctgtgaaagaggctacagtttcatcagcaatacctttctttctttctttctttcttcctttctctttctttctctttctttctttctttctttctttctttctttctttctttctttccttctttctttctttttctttctttctttctttttctttctttcttttttccttttcttttctttctttctttttttttaagacatggtctcgctatgttgcccaggctagattgcagtgatgcagtctcagctcactgcagcctcaacctcccttgctcatgcaatcctcccacttcagcctcccaagtagctgggattacactgacgcaccactacccccggttaatttttgtatttttttagtagagacggggtttcaccatgttggccagggtgttgaactcctgacctcaggtactctgccctccttggcctcccgaagtgctgggattacaagagtgagccatcgcgcccgattcttttttgaatgtttggaagagttcggctgtgaggccatttggtcccgggcttctctttgttgggaggttcttcagtccttttatttgttattggtcgttcaggctttcggtttcttcttgattcaatcctagtcgtttgtatgtttctaagaatttatccatttactctaggttatccaatttgttggtatagagctgttaatgatagtttcttatgatcctttttacttgtgaggcttctgttgtaatacctccactttcatttcggatgttatttatttgagtcttctctatttttttcttagtttagccaagtgtttgttaattttactttttccagaaatacaacttgggtgtgagaggcctacgttgcatcaccactggaggccagtagttcccagtaggcctgggaagaatagtaagatgttgtctctcctaaaaagagggagaaagagaaaggaaaaggaaaaaaaaaacccaacaactcagttttgtttatttttctgtagtatttctattcttcagttgattgacttctgcatcgatatgttgtttcctttcttcactgaactttggatttattttgttgtttttttcctggtttcttgaggtgtaatgtttatttgaagtctttcttcttttttaatgtatgcatttatggttataaacttgactcttagagctgtttttgctgtttccaaaagattatgttgtttgttttcacttttgtttgcctcaatcaaatttcccttttgatttgttctttgatcagtcagttgttaagagttatgttgtttaatttccatgtatttttgaattttccagttttccttatgtagttaatttttagtttcataccattgtggtcagaaaaaataattgatcggattggaatcattgttaatttgtctaagatgtacttttcattattttaattaatgtataatagttgtacacattttggggatacacatggtattttgataaacatatacaatttgtaatgatcaaatcagtgtaagtagtatatctgtcacctcaaaactttatcttttctttatgttaggaatatcccaattcctctcttctagttattttaaaatatacaagaagttatttttgtatatactatcaaatactagaacttattccttctatttaactatattttatatgcattaaccaataccttttcttccttctctcctgtctccttctcagcccatctccttctctcagcctatcccctatctccttctcagcctcttgtaaccactaatttttatatatgatatgacacatgaattcaattttttctacttgtttatttttatatagttacaaatatgttacatcaattgcttaaaaagaaaatcctcaatcatttgttgaaatattatgtatttttaaatacattgcttttttaagattgtcaaaaatctgttctcaatatatgtattggtttatatttggactctattttcttttgatccatttaattgatcacataccaaagctctgttgtggccattacaactctgtgattgttctttaaatcaggtggagctagccctccaattttgctcttcgttatataggcatttttgttatgctagttcatgttaattttagaatcagctgccattttctaccaacgatgcatgctgaaattttgagtcagattgcattgaatttatagatcaaattaggggaaatggacatctcaacaatattcttacacatgaacaaacaatatctttccagttattaggcctgcactatgttctctgtgaaatatgctctaattttcagtcatattcacatttatggattttatacacttgacattattgtaaatgatattccttttacatttaaattctgccgtgcaattgcataaatacaatttatttttgcatattgatcttatatcctgctagaaacaaatgctttttgaattcaggtttgatcggccagtggcagtatctttggaaactttcatatttaccaggcatgaagaatctttctcatttcaattggacctttatcaccagcccaagggagaggaaagtcctaacgcatatcaagttctgaggttgggaagagttgtactttgtagataaatgcatgtgaaatgttctgtatgtttgccaataagttttcattaagattactcatgcagttataaggctgcccatttgcacttgtgtttagctgcaatactatagttgtaaaatttagaagccaatgttctcccttagtttaaaatttaatattcaagaatttactccagtattatgtagtgccagaaactttgggatgatatgcaatgatatgtccagcaagtatgagtttgtacctgatccttattagtcttccttctgatgtgatctattataaaatgagaccttaaagagctttaaaataattaataatggcatgctgaggagattagtttgtgggatattcagtagccataggaaacagtagttcctactctgtatctcaagtgagagtccactcttcagtatgtcagcttcaagaccctgatctgcagtggaatttgcagccccctgctgtgtcagcttcattacttcaagggagggtgaatgccttcagttctttaggtcacaattgacacatgtagcacattttggtacctcttcagttactgacctttatgcccactcatgtcaggcttgctcacctgagtgattcacaagatcacattcccaatgcatcagatcactgtgtcacaaaaaaccaaaagcatttatttgtcattatgtatctctcctgaatttcaaccttgataggctaacatggctcacaaacagctttaaatttggcttctcaaatgtctgtctaatggtttacaaaagtccagttactcaaatgaatttatcttacagtccggtttctattgttccatgctgtgcctcagtgacataaaccaagagtcagtatatacaaagatttattcccactggtttataaccaaccaataaatagtatgcctgttatatatagttctgtgcattgggttgccagtctccttccttcttttacctgattgttattggaagtggagatgatgtaatgttatgggtcacttctattagcgtccctggactacagttctaccatctattttttaagctgttttaccttgttatataagatctgcatatttagtagcatcatttatgttattaatagttaacatctatggtagtcacttctttggttaggtcagagactaaaatctgaaaattagaaatccattctttatttcaggtgtgtgcatgctgttgtgttgatccctctcctctcccagaaaagtcattgtaggcccaagttgatgaagggacagactgtgaaagaatggatgcagagcatggactaagtatgcagtgcccactgagttgaaaatgttgctaaagttgcttttctgcgattgtctaacattcctctgagtcacctcgtctgctgcttaagaaccccaaagcattttcttcactgtcttgtggccattgttataaactccactctgttcttcctgtgtcaactaccacacagtctgtttcattccatggccctaaaggcagagccatttttccaattttaggtacactaagggtatcctgtttctgcaaaaccaatggatgttagtggttctcttagttgttgttgttgttgctgttgtttttttttttttgacgtatgaggccataattggagtaatgtgaaaaatattttttcctccagaagttattagatgctgctatatccaatatttgttctatcagtacactataatgtatcccagctatgcattttatatttcctaaaacttcacttctgagaaggcccttcacgagtttttagaaattcatggcccacccagcagcattactaagtcttttggagtctagcctcatggtctttctgttgattttcctgctgtcaacatgtaatctgtgaaatgaaacaaagggaggggatccaggccaagacttggcgacattcatttatgacagtcagtagtcagacactatgtgcagagatcctccagatcctgtttgaccagcatctttgggaggttaagagcccagccctgtcagaaccactattcattatcatcgaccctttcaccagaatgcacctgtgtgtcggctactgattttctcacctccaggcaactcaggctgagctgggagcagaaatcttaagctcttgtcactaaggactcttctgtgcttcctctgtatcacccgccataactagcataatgctttactcacaggggctcaggaaatgcacttgttgagctcaacaaattgagaatccaagttgcctgataagcagagatgttatggtgtagagaattggatagggtaagcagaggaacaaaacaggttgtcattttgttgttattgttgttgttgttgtttcttagagtacaaaaattgtgactggcaactgctggggaatcctaaggcaggactttagtccctaacccccctacattctcactacattcatggaagctgctttactcctttccaccttaggtatttaatctataattagaggataaaatacacaatttctaaatgctagtactatgactgatatagaatttattttggacacaggtgaatcttgaagtctgcaaagcatttcaattaccaaacagaggccaggcacggtggctcatacctgtaatcccagcactttgggaggctgaggtgggtggatcacctgaggtcaagagtttgaaaccagcctggctaacatggtgaaagtccatctctactgaaaatatagaaaattagccgggcatggtggcctacacttgtaatcccagccactcaggaggttgaggcagaagattcacttgaacccggaggcagaggttgcagtgagctgagatcatgccattgcactccagcctgggcaaaaggagcgaaactccatcacaaatatatatatatatataaaagtagacagaagatagatcatctgtgattactatgtcaaggacaattttagaattcttgttaaactcacctctttcttttcacagctggccaggacttagtcagtatctactgaaaccttgaatatcttggctgtgttaactgttttgacccaacatggagcgaaaatgttggttgtaccttgagattctgacatctggttgaagtccaggttcactggcccaggacaggtcattcagctgtttgaaaaaaaacagaagagagaccaggccatccactgaggtaatctccatgcagcatgaaccactggttccaatgaacccaccatcaccatacttctcaggaatcgctggtcactagactgagagttctgtgaaagctgagatcatatcttactaatctctgtgttcatggttcccagctcagggtctagcactgagggagttctcaggagagtgttcatcaattattgaataaaagcgattgcaaacctcctctcacctgcattcctgtcccaaatatcctgtcagggatgctgagatttctcccaggatgcagcaaatccctttccttagactggcccttgccttacaccattcatgccccaggatccgtctctgtgggacattagaggaaaatgagtctgttctgaagaagtcctcttatggttccccctgtcgttaggagcaatgtcttcacctaaactcccactctctgggttgccacaacaccccaatgtgggggaacttccatattttcttaaaatgctatgtttctgttctttctctcatgggcttgagttcctttggggagacattaatatctgaatcccaagtgtttaacacaatgtaaagaaaattaaacacccaataaatatttatgagatatcatttggaaacctccttcaactgtaagtacagaagaatattataagtatcactgctttgtatactagcaagggacgcttactctggcacctgacctagggcagagctttttatgtaagaatggatgtctccaacccttctcccagcatggttattccctctaacccacactgacctgaagagcatccactgctatggcagccccaaggtcaaggctcctgggtctggggcggggctcatggtcgcatcttccccccttggagttgctgctgccccctcactataaaccagctctgatccaccctgtggctctccctggccaggggcaggagactcctgtggagtaaatttctctctcagtccccactgctcagctcacgctactccttgagggcttggatgatgataggcattgcccatttcccctgaggcttctgtcccaatttgtccttatttcccccttctttggttttcatttaccaatggcttgtcctttgtgggttgttctcatcccctaaacctgctgactttctttctttcatctgttccctcagttctgggcttccagtgtagggactcagctcaggctcctgcaggagacacacagagtcaggtctcagctgcaggtcctgggtggcattaaaaaccatctcagttcctcagagactcagagaaaacaaagtaggaagggacctcagagaggaacaataagcccctaactcactgaggaggaaagtgaagccaagaaagactaagactctcccaggctccctcaccacatggtggcagcagatcgaccacacaagccttggcctcagcctccaggtctaaagcagctaactcaccctccaggaactcactgctgtgtttcagaaaactttggatcaaaaacagcaatttccactgtgaaaacaaataaagtaaaagggcttttccttggacaaacgctttataaccgttctacagtcctagtatttatgctcagtcagttgtcattcactggctggtagattggggcagggagcacataaagattaagtaatgtttaacacaagcctgctttcccagcctgggatctcagctcctccattcttcagggagtttcctctcctgaaactgctggagagtctcagccctcatgtgggtcatttctccatgatgatacctgttattttcttcctctcctggagataagacagggcagagattggttctgggtctccacaattctaggttttctcctaaaccagccaggtcagctggaagcaatcatgacagagaggtcaggtcagtgaagagggtcccaggggagcagggggtcacaaggacagcccctcatggagatggtcaggaccgtgacatgggcaacatttgaccaattctgctggggataatgtgccaaggattaaggggaggatgctgccataagtagaaagaggaagaaccaaaggagtaggagaagaaggaaaataaaatgatttctataaagatagaaagaaaggcagagcccagaggcaagccccatgtcacagagggttagttccaggttttggatcctaaccaagaaattcctgctggactttgctcagcccaatttcaaaaaagttttggatcagtgacttctttgttacttccatgtttcccctttgtgaacaagaatcgctagaatcatttttctatgtctgtcccaccattgcacacagagggcagataagccgtttgttcagtttcacaggttgatagagggaagggaattatgtcaaggatctggacttaatggacaccctcagaagcctcattcacacttggtatagttgactaagataagattttaaacttttgatctggtgtggtctacataacatttttcactttgagctaatgctttaatgacatgaaatttggaaaccttagagtagagggtgaatgtattttgcaaatgggggaatgtgagtgtccgactgtggtagatggaatttctgaaatggcccccaaacatgccacacccttgtctctaaagcctgttaaggtgatgaaacatcattcctgtgattatgttgttatatgccagttatatgactttaagatggtgaggttacctgtgtaaactggatttaatcacatcactgcacacatgccagtggtttctctagctgtcaggagagggtgatgtcagaaagaaagggagcttgagaaggactccatgagctgttattggttggaaaatggaaaaggccaggtgagaaggaatgcaggtggcctctggagttagagcgtctcctgcctgacagccagcacacaaaaagaaaacccagtctttcaaccccccaaaaatgaattcctcctacacctgaagtgaacttggagaagtagcctgagctccacataattacatagccagacacacctggattcagcttcctaaaacccttatcagagaacccagcctctgttccagacttctgtggtttcaatccactagtttgttgcatgtgttaataggcagcaatagaaaactggtacagatgcctatctctactcttgatttattatttcagatacatggaagctaatccctctaagagaaaaaaattaaagagcaaagaactacagcaaaaatcttgcgctcacgttcacctttatgtcactattctggagcccttgcaacctgaagaagataatgagaggcattccaagcatgtgaggagtatctctaatgttaccaaccaaatttctgaaagaataaagatggtacaatactaactccacataatcttatgtgcaaattcatcatctatctctatttcttatagcagatttctttttcttttttagctcattcatttaggcttgccagatgaggtttggtaacaactatcagttatcagcaaaaatgaaacaactaatgaagagcaatgaacaggactattatgttcctcaaaaaagtccctaaaatgcaatatttcctctaaatgtcacaaaagtaagacagtgattcactattaaaaatcctaatctaagaaaggttgaaatttaatgatgttggttttccaaatttttattttgttgtggcccagtcatgggcaccagagattaggaaatgactgtgcagaggcttgagggaatttgggaaaagacaaaaatattctaaaatgtgacactgctgatggctgcgcaattggtgagctttattacaagtaagcttttttgtttgtttgtttgtttgtttttgggggggatagagtgtcactctgttgcccaggctggagtgcaatggtgtgatcttggctcactgcaacctccgcctcctgggttcaagtgattctcctgcctcagcctcctgagtagctgggattacagggacatgctaccatgcctggataatttttgtatttttagtagagacggggtttcaccatgttggtcaggctggtgtcgaactcctgaccctgtgatccacccacctcagcctcccaaagtgctgggattacaggcatgagccaccgcgcctggccacaagtaactttttatatgaaatttccggtttcaattctgacatataaagaggtgggaagtcaccatttgtcctcacaacaagaataaagctgaacaaactgaaaaccaacaactcttcttatacggccagagaattgaggtcgctgccaccctgaaaactagaaagacaggcaaatgcacggagtcacagcttaccaggaacagaaactgctggagccagcacctgggaggagaacttaaatagtattgacagattactagaagctgagggtggcttggcttgagcattaaaaacgctctgagaaccagtcatggggggaatctcacactttcctaaatctgaccactagaaacccaacaaagttctcatggagaagatcagaaaaaatccccgaggattggcactgccaacttcagctacagtaaccaaaacagtatggagttggtgaaaaaatgtaaaacagactcatagatcaatggaaaagaaaacagagcccagaaatagacctacataaatataataaactgatctttgataaaggtgcaaagacaatttaacagagcaaggatggccttttcaacaaatggtgcgaaaacacctggacaaccacatgaaaaaataaataaatgtacatacagatcttataactttcacaagtggatcttataactacctgtaaggttcaaaaccacaggactcctaggagataacacaggagaaaagctaggtgaccttgggtttggtgatgatttcttagaaacagcattaaaagcgcaatccatggaagaaacaaaattgaaaagttgaacttcattacaattaaaaccttctgctctgtgaaagacactgttaagagaatgaaaaaacaagtcaagactgagagaaaatatttgcaaaatacagatctgatgaagggctggtgcccaaaataaatgaagaactcttcaaactcaataataagaaagtgaacaacccaatttaaaagtaggcaaaagatctgaacacctcactgaaaagatatacagataacaaataagtatatgaaagagacactcaaagtcatttgtcattagaaaattgcacatgaaaacaatgagataacagaacacacctattagagtggctaaaatctgtaaaaagtgacaatcccaaaagctgtcaaacaaacagagctacaggaactctcattcattgttggtggaaatgcaaaatggtacaatcactttggaaaattgtttgggagttttttttttcttttacaaagctaaacataatcttaccctataatcttgcaatggcagtttgacttatttagccaaatgagaggaaaacttatgttcacccaaaaacctgcacacaggtatttacagcagttttatttattattgtcaaaaactggaagcaaccaagacgcccttctcaacaagtgaatggataaacaaattgtggtgtatccatacaatggaatattagtcagtgatgaaaagaaatgagctatcaagctatgaaaagacataaagaaacattcaattcataatacctgaaagaagccagtctgaaaacctacatattgtatcattccaactgtaggacattctgagaaagtcaaaaagatagagatagtaaaatgatcagtggttgccaagggtgaaggagggaaaggagggatgaactagtgaggcacagggagttttcagcagtgaaactattacatgatactgtatttgggagtcatgacactgtaattttcaaaacccaaagaattgttttaaaaaaataagataaaagacaaaacacttaatgtgaactatagacttcagttgatgataattatcaatattggttcatccagtgtaacaaatgtaccacaatactgcaagatactaatgggggaaattgtgtattgaaggacagggaggcacatggaaactctctatagtagctgctcaatttatctgtaagcctagaactgttctataaagtaatatctattaatttttctaagttagaatgtgaaagctccaaattcaatttttggtggcatcctgatatcatgtggttaatacttggcattgagatgcaccaaactggagtcagagcagttgaagatttcaatgtctgtgccttcaccctctgtgcctggggatgcccctggaatccagatggcagatcagttaggtcgtagtggcatcagcactccagacagtgtaggttctagtaaggacagggtgaaatcaccttggagggcagaacttgctaaatacttggaaccacagatcaaaggagaaggagacagggaggaactgcaggctacagaatgagctccctgactgaaagataaaggcagcttcagagattttggcaaattttgtgagagaattaaatgtcagaaaaagaacttagatttcagtgcaaagtggtctatttaaaaagaaagagaaggaaggaaggaaaaggagggaaagagggagggagggaacttagatgaagactagaatatctgggaatgggcttaaaccatcaatcgtttccattaatgaccacatgctaactaattatagcacagagataccatactgtaacatcaagtacagttagcatgggggtaagaaagtgttccccaacctctccgttctcctctgaagacacattttcttctgaagaacagagatattgaatcttgcctttgggtaagtttgggcatccacatgaatgagctggggcacccaacaccagattacaccaggccacgaccttccctgctgccccttgcctgcttcagaggctgccccgctgcaggtgggggcctcagccccaggtctgatgttgtccatttgctttctcactgggcttctttccttgcactgacttccactccccaggactcagtgagtggccacatgggaaagacacaaactggccatgcccctttctctctgacacctcttgatgcctgcagaggtgagctccagacccactccatgagtagtgacttgagacttgctcacaatgatgtccctgtccaagagcagggactggcacttaatagccacacatgaaagctcagtgaaagaaggcatccaccacaaggtcctggaggaaaaagaattccactatggtccataacgttttagtcccaaaagatcccagattaggagatgtgaaaggcttttgaaagtggccattcttttaaagcattatgctggcagctgcactatgtttccccatcctggacatgtctggagggcactgtctacagccatacccacctccccacccaggacagtgcagcagctttaatttgggggatgccagtgggcaaggaaggggtgaaccatgaaagctgaacaggagaaagcaggtggaagaggggcaacagggtggaaatagagaaaataaaggtgggtagagaatggggggactcagggggagagagagagagagggagagagagatctagccactaaggaaggaaaaagtccagaagagaacacttgtctgcttcagtaaaataatttacacctaaccaggtgcaagggcactgcaggtcgtgggtggcatgccctggtcatgctgtgatgtttaggggccatgacatctaccctttgaatccaaatcatcaaatagagagggaactctgtccctatctagctggcaatgccttgcgattttaccttttagatctggcagctctccacatctgctcactttgtgggaggcagctcttgacgcaccaaatcaggatgattcaaaaatcagagccttggagacttcactggaaggcttggacagtgggaggtggtggcatccggagggtggagtccaagaggtagcagcgctgaggctccacacaccctcaggaggatggtaaggggcaatctcttggtgagcacctaacttccccaggaacctctgcctaggtggaaatgggccccacgcctagcttttctctggacaggccctagccagggatccagggtaccagttgagtcctaggcaatgcaaatgcctgtgtgctgaccttgtggtgactggaaggaagcaccatgatccttccacttggaactggacttgcaaagacgatggctcctactgctttcaatttccttggactttcgcaatcagatttagccttttggaatgtgaacatgactcttctgggtcaccccaggtatggggtggccttggatctgctggtcctccccaggcctcaaggactggctgatattcatcatctcggttggtgtcaccgcactcacaatccccagcaaagatcccccaaagtgtcctgactagaaacatattcctcaacttcctctcagctcgtggtagccattcttctgttagtgtaggctgcgtgtgggaggctggtggtgggtagggtgggagcctagagaaggaagaggaacggtagccaaaaaggagcagagaaggaggaggaggcaggaagtatagaaagctggagggagctggggaaaatgggtgtgggggtagtgtgaggaagacagggagcaggagagagaggggactggaaacagaaggagaggaggaggagaaagaggaggagaagaaggcagaataagaagagcagaaattccagcatatcccaaatcttgttccagaaatggttatcagtgccccatggataaagggaaaaggaaatttgcaaagaaaaagaaagaaaccccagcgggtagagggtctcggcagaatgtttatttcagagcaggaaactctggcaacccaggcagaactgttggctttagtggaggcctaaatatagctcttctctgttcctaatcctgaaaggtgcttaatctcattctctgagatagaaacctaaagagaagggcagagagaggtaagtctggggtgactcctcctattgtagattaaaggtactcaagtcctgtgtgacaaagagaaaaaaatacctgaaaaggaaattctggtgactatggaggctgagaattcacttgtcaaatgctcataactgagagtattctcaacagctggttccatgggttaatggtgagcaccctggactctgaatcaagcgatccgagttcaaatctcggtggtaccttggtgtctgctggccttttactctggagccagaagccactttgggaagcaaactccaccctcaaagacagagtgaaagggatgtggtttacatttgcccttcgtaccaagtcctgggttaaagaagagaaaggaaggtttgggtcccggggaaggaagctctgctgctgcaaatcccctagtccctcctgctccggcctcgcaatgcgtcccctgcaatgtccctcctcctctcccgtgtccctcctgctccggcctcgcaatgcgtcccctacgatgtccctcctcctctcccttttcctcctcagtggtctgggtcccagaaaccggcttcttgcagtggcctgctccacagggaaattgcccaaacatcccatcggagtcaccaatcctggtcccagtcctgggcgagcctcccggccccctgcaatcggaggcccggaccccgcagccagcgtcccagcaaccgaacaagtccccatcccctctcagggcgaccctgggcctcggggtgagaggtttcctacactaaaagggctgcggcccctcagtgctagaccccgagattcctttcactcgggaaatctcgtaatcgcatccattgtctttttggtaagtaaacggtgacgtgagaaattttgatggggttagctcagtcattggtgattatgtctcagtttagggtagatggtttgagacctaacttagaagtaacactgttttattcggatggcccatcctcttccgaatgttaatttactctgttcttcatattcagatttccatgcctaatttctagctcctacgtctctattgcgggacctaaaagtcgctgtttcactaagctttggaacccgactccaggaaatctcattctttcgtcccaaaatttcaaccgtaaagagaaatccgcgcggcggcctcttcaagcgcccgggccgggagcgcgggttctgaccttcggtcgccgggccggtctcccgcagcaccacgggtaagaggagcctgagcagctcggagggatgagtgcgggacggtgggggctccccctcttcctgccagtaccttgccccaaggagaagatgccttaggacgcgacagatgaaaaatcttttcttctgcttggcggaacactttggatgcggcttatggtgggtcttgagagcaagctaagatgtcccgccagacgctcaggaccatcgctctgattttcatattttgcaaatatgaaaattttcagcggttacgaaggactgaaaaacaccgcagtctttgaggggctcagtttggagggcgtgcggaggtgtggggtgggagacgggagagaggtgccttgttggctccttggagtggactgataggaaggaaaacacacaaattccatttccccttgcaggctggactgcagggcctaggatggaaaactgggcagtcaaagagcaacaatatgtagaggttgactgcatgcattgaaaattgttatccctcacacctgtaatcccgcattttgggaggccgaggcagtcggatcacgaggtcgggagatgatcatcttggccaacatggtgaaaccccgtctctactaaaatacaaaaattagccgggcgtcttggcgcgtgcctgtaatcccagctactcgggaggctgagacaaggcaatcgtttgaacctgggaggcggaggttgcagtgagctgaagctgagatggcgccactgcactccagcctggcgacagaacaagactccgtcgcaaaaaaaaaaagaaaagaaaagaaagaaggaaaaaaggaaggaaggaagaaggaaggaaggaagaaaacaaaattgttatccctagaaaaaagtgtaggggggaccagaacactgctgttgttgctgttcaccaccagctttagagcatatgtaactggtaactgtacagtgcatcaaaaatccttcctgtttacaaccaattatcacaactagctacagatttctttgttccttctccactcccactgcttcacttgactaaacttaaaggaaaaaaaattgtttttacatatgatattgtttaaattgatcctcagcccgtcctcctcaagtagctgggaccacaggtgtacaacacggtgcctagctaattttgtagagacaggggttttgccatgttggccaggctggtctcgaactcctggactcaagtgatctgcctgcctgggcctcccaaattgctgggattacgtgctggcctccatgcccagccatcatttgtattttgaatttaaatattttatagtcataagtatcactcttcaaagattctgagttttgtagcatgtatatggtgaggttcaggacacactactccaaaatataacaccttggggtattgaatattttatgctaaaggaatttgagaaaacaacaaaagcaggaaggtcactgtcaccctccccctgcccttcttccccaaagcagatcataaggctctcatgtgagaggtgctctctctgtacccagaggaaagatgcattgctgtgtctgaagacacagcgacacagagtctgagcacacaggcctggctacatttcccccagtttattaccattagatcatactcctttcatcatatctcacttctctatgactatccactagtcatcaaacataccgttaaaaaaaaacaacttgaagtttagctgtttcttcaggtcttcatttctttaggaaggctcttcttctatcatgtaaaacttacattaaataactagatatgctcttctcttgttagtctgtcttttgctataaggttctcagcagtgaacctaggctgggtgaggaagagtcatatttcctcccttacatgtacaaaatgtcttccactgtaaaactgtaaaaattttattgaggcaggtttgaagcaagaaattgaatcattattcccctttggatgaactgaacagatgagctaacaaacccccagttcctcccagatagaaatacttctctagctcattccctgaatctccttgagggtcaaacctgctggagattgaggggccttcctgggacctcccagcccaggagattactgctggtgagaagattgctgcagtttccctgggagggtgcacagccactggaaagtatcactgctgtaacttcaatacaacaaattgtcatcatatctgctcttttggtttatttatttttttggagatggagtctcactctatcacccgggctagactgcagtggcacaatcgcagctcactgcaacctctgcctcctgggttcaagtgattcttctgcctcagcctcccaagcaattgggattacaggtgcactgccatgccaggctaatttttgtatttttagtagagatggagtttctccatgagggccaggctagtctcgaactgctgtcctcaggtgctctgcccactcgacctcccaaagtgctgggattataggcatgagcccttgcacctggtcacatctgctctttgtgcagtgttgcaggcataatacaagagctaacatgcaaataagtaacatatgaacactcatcaactgtgcctgacatgccaagtgccacatgtcaggcacagacaatgagtgtgcataattacttatttagtctttaccacaggccaaggtcacaccatcatctttatcttccatatgagacaactgagatgcagagatgttaagttacctgcccagggtcactctggtcagatttctttcactgtcatactttttctatgtcaagtttttctcactgtcataattttttccagggcactttcattaggagcaatataaacacagtggttctgagaatgtcttctggagctaggctgccttcacttcaaattcttgctttcacatcctccttccctggctaagtgaccctgagcactgcatcttgcttccaacctccaagcttcccttgtccattcctggacataagccaggctaaatatgagaggagtttagttccaagtctaagtgtgaaacaaagatgatagccctttcccgagacaaacctcttcctttcttggggatcagacctccttagcaaagttaacaaattaggcacgagattggaaattatggctcaggagctatgaagccagaagccacaagattcctaagctccccaattgtgcctatagataacatcattagtgtcaaacctaagattggtgttcaaggtatttttcagaccctgccttatgatggactagctggcacacccagaccggtaaactggctcatctggtcctgtggcccccactcagggactgactcagtgcaggaagacaagctctgactccctgtgatttttatccccaacccaaccaatcagctttccccattccctagccccttgcctgccaaactatcctaaaaaaaaaaaaaaaaaaaaagtgtcctctgaatttggggggagacagatttgagtaataataaacctctgtcctggtcacttagctgtctctgcatttattagattctttctctattgcaggaagcctgcttttctcagctccattggcttttctgggcaaccagcaagataaactcaccagttacattaataaaagagaaacacaaatagtacatatgcttgaaaagaagtgtaagtctgtatatttcttttgaagaaacaggaaaggaggaggaataatatgacaggcaacacactgtcctaaatattttcatgattctcctgcctccccatatccttcttatcccaacaactgctccctagaaacctccaacttaaacacaatcctgccagaactaggtttgtccttctcttgcattttcctctcacttgccccacaccccttccaaatctgttctttcacttccaggtcattgagtttttccatttaaaaatatgaaagatacagaaagaagaagataaccagtcatccatattcccaccacctggaattaagtactgttcacatatgtacatatttttcttccaaatcattttaaagttactctcattttttttaaattatacatgcttagcataaaccataacactaatacagaaaaagtacagatatgtaaaatttctgatcaccataagttcaaaataacttttgttaacattagggcaacactgattgaatcatgttcttctggtatatctacagagagaagaatgtatattttagctagactgtccccccaacgcccctgcaaaagaaaaaacagaacaataaatatatatatatatatgagctatatattatatatatacatatatataggagctattatatagatacatatataggagctatctattatatatatacatatatataggagctaaatattatatatatacatatacatatatatatatacatatatatatatatatgtatatatatatatatgcttttctaatattgagcttagactctatttttattttacaaatattccatttgggtccggcgcggtggctcacgcatgtaatcccagcacttcgggaagccaaggcgggtggatcacgaggtcaggagatcgagaccatcctgggtaacacagtgaaacctcatctctactaaaaatacaaaaaattagccgggcgcggtggcgtgcgcctgttgttccagctactcagaaggctgaggcgagagaatggcgtgaacccgggaggcggagcttgcagtaagccgagatggcgccgctgcactccagcctgggcaacagagcgagactccgtctcaaaaaaaaaaaaaaaaaaaaaaacaaaagcaaaaacgaaaaaacaaaaaacaaaaacgaaaaaacaaaaaacaaaaaacaaaaaacaaatattccatttaatggtgcatgaatttaactgaagacaaagagacagaaacagaaacgaaggaattcctgaactctcaatcacatttagagagacgcttttctaaaggaatcctctaaagctaaacataagttaaattaagtagaatgcattatgatttgcagtgtttgtttgtttgtttttgagatggagttcttgttttgttttgttttgtttttctctgttgcccaggctggagtgcagtggctcgatctcagctcactgcaacctccgcctcccaggttcaagcaattctcctgcctcagcctcccaagtagctgggattacaggcgtgtgccaccatacccagctaatttttgtatttttagtagagatggggtttcactatgttggccaggatggactcgatctcttgaccttgtgatctgcctgcctcagcctcccaaagtgctaggattacaggcatgaagcactgtgcccggcctttttctttttcttttgttttctttttctttttctttttttttttttttagagcagcatcacttgctctgtcacccaggctggagtgtagtggcgcgatctccacatgctacaacctccactcccaggttcaagagattctcctgcctcagcctcctgagtagctgggattacaggcgtctacatcacacccagctaattttttttgtatttttagtagagatggggtttctccatgttggccaggctggtttcaaactcctgacctcaggtgatccgcctgcctcagcctcccaaagtgcaaggattacaggcgtgagccaccacgtctggcctgcagtggttttcttactactttttacaatcaaattgattaaggcattggttgaatatggtacaatacatccatttcaagtttgatgacatgtctactactccagaaggtcctcttgtgccctttgcagtcagtcccctcgactccctgaccccagcaattaatgatgtattttctgccactatacaggttagtttcacctgttccagaaattcaccttgatggcaccacacagaatgcactcttttgagattcacccatgttatctcatgtttccataatttgtcccatcttactgagggtggtattccattggatgaatatatcacaaaaggtccattcacctcttgatacatatgaactgtttccagtttggggactattgtaaacaaagctgctaagaacaagttctttttgttaatatttgttttgtaaattccgtttgtcattctttagtattaacttattttgtaaaaggacgtaatcttcataagtgcaaaattcattcaaattttacagaggcctgaagcagaagcctacacaatttcctttgttatatttcataattaaggggaaaaaaactttatctgggatgttgtttcctatcagcaaatccttaatgtaagccatacaggatgctagctgtactattagactatcttctgtaatctgtgcaataactctaagaagtacttcgtcttattattttcctgtaacactttccaacttgaagcctagcaaattgaaggacctggccccaggtcaaacagaaggcaagcggcagcgccagtactggaagaaggccttcccaaaggcagacagaagctcacgtctttgtcagaacctcggtatttctgatgcgcctggaagccaatatccaagccgttctcagccactggattggtgggctgctttgctcagaaactcctcgatcaggaatcccaagcatacgttagtgatgacggtcccaaaacaagggacatttcttaaccattctaaaaacccgtttgctcattagtaacgcaatgaaagttgctttcgtcttggttcatatattttatatttgagcaaggcaatgtccgctgctggggttagaagtaaatggctcgtcttcatcaaactagatcagtccgtaggacgtatggcttccactcgcagtgtcctgaacactggctgggcttcctgtgcgttctagccggttttctttggagccgcgggtttctgcaccgcaccctagtcgggatggcagaggcttctcggaacacgcggatctatgagtgcagtccccggggtagccaccagggaacgccataggctttcccgctgtgttcctccttgccttttccgtttgggccaggtagtttctattgaccaggacattacagatcagaagtgggtggggtcagaaaacacaccctgggagaggctggcaaaatgcccagaaccgccatcactaggactggggttttcttctgtagtggaattctcgtgttcatgtagtgcagggaggatcgcagcgcatttccgccaagacaagtgagactgcggttctgacctgcgggcctcgatgaattgcgttaggacacctgggcgctggcagagccgttctcctacacaaagcaagcgtgttatgtctacaaccgaacggggacactaagagccccaaaggccctgctttcatcccaaagaagagtgcctgtctgcgtagtttccacctggctctatgaggtgagaactgattcctcgctagcacagaaatcctgaaacagaggctgtgtaaaaggtgacaggggcctaggggaaaacacgaagattttcacagagcgtgagaccccaagagactggagaccatggatcaatttttgcaataagcagccttatgttcaaagggaaaagctatgcagccttcgcgctagttaacttgtgataaacaggctcacaacggctgacgcttgttccttctccagcgaggacaacgacatgccacttctgttccccagccatccaactgtaaaaataacatgacaccacccatattatgcactactaaaagtatcccttcacatacaatctgcgttttccagcacaaaattcagaggacagcgcgaacgcagtcccccactaccacaaattatgcagtcgagtttcccacatttggggaaacggcaggggtcagcacatccggagtgcaatggataagcctctccctgggaaaaccaccttcgtgatcatcgtatctcccctgccaggtaagtatgagatcatacgcctccgccctgccacagctccatacgcctcaccccttacacgcacggtcacttcccacgcgcaaccccccaccgccccccacccccacccccagccctcctagccctgacacacagctgggactatcacgtccaaccggcggtcctggacttgctcccacagcaggagaaatcctccgtggcgaagcagcagcccctgagatgcctcatctacacaggaatcgccctatccgtgatgtcaccgacagcacctttcccggtccggctctgctcttctgccccaccctctgccacctcagccgatgaacccgctgcgggagccggcggaggaagtgacgcctgcctctccctcttttccctcccatccacgcccctggtctctcccagagaagtaggttcttagtctgtgatgccaaggacccctttggcggccagctggagcctgtgcgctcttcttcaaataatgtcttttaatgcgcaaactagaaagttcaggattacaaagaaaactggttcttttcacatacggttatccttgtgatgtagcattccgcttgacattggaagtcgttcgatatcagagagaaaccatatctacgaaactagagaggctgctcagatgactacaaaccagccattcttacttgttttatcactgggagtgttataaagatggtcgtccagtttcatgattcttgcagggttttttcaaatacagcaatgtacaaaaatgtgctgctccagcagagcacactggacacgcagacatggtgccggagtttgccatctcttccactgccttctctagaccttggcgcttacctcatgttaacagtttatatgctgcaaagacagaaacaaagtcatccaaatttggcaaaaatatttgggggaaattttatttcaggtgtttaactgattacttttaatatgtagactacaacaccaaactctgacaatactccacagacttattaatggtttccacccccctctctgcaaatctatcaggcaagtttttcctgcccttcactttcatataagctgagtcatacagtgtgtagtgggttttgtggggagtgttactgcccaacatgttcaccttgcctgctgcctagacagagccaatttttcgacacaggggaattgcaataaagacctgcactttttatttggtggttgggggccagtgagttgagagttgtgattggtcaggtcggagatgaagtcacagggagctgaagctgtggtcttctgctgggtcagttcctgcgtgggggccacaagaccagatgagccaggttatcagtctagctggtgccagctgatccactgagtgcagggtcggcaaaatatctcaagcactgatcttaggttttccaataacgatgtgatctccaggaacaatttggggaggtttagaatcttgcagccagaggctacatgactcctaaaccataatttctaatctcagggctactttgttagtcctgcaaaggcagtctagtccccaggcaggaagggggtttgctttgggaaaatgatattatcatctttgtttcacagctaaaccataaactaatttcctcccaaagttatttcggcctgtgcccagcaatcaacaaggacagcttggacgttagaaacaagatggaatcagttaggtcagatctctttcactgtgataattgtcccagttgtaacttttgcaaaggcggtttcagaagcagaggcataggtttgacttctttcactcagtcttatgtctatgaatttttcatgttattcatatggttatttgtttctatgtgtattcctttgtaggaatatacactaacttatttatttcttctgctattgttgagcatgttgacctaaaagaaagaggctgaagcacaaaatataatttagagtttacctgagccaacatgaagagagctgcctggaagactcacactcaaggaaccttggatctgagctccctttgatctttgtcacaagcaggtatttaaaggtcaaaagcagggacagacagtgggctgacagaaaggtgcctgtcaggagttctcattggtttacagaaataacattgattggtgattggctatatgttgttaagttatagggtatgggggtacagggattggtgtggcattattaggttaatttacagctacttgaggcaatagcaagcagtttcaacagatgaatacatagctcagtgcagctcaaaaggaaggagcagaaagtggttgctgtctcgatttaacctctctctgggcctgatcatctgagagggctcacattcctcagataaaacatttttaaaaaactttcttcttgaaagcattgatgatcaaaagctcattcaaggtgtccctctttgccagaaaggcttattcctggatagtcctgtcccaggcaggggacaggggaggaaagaagccacctcactgaggaatttttaagaatgcccaaaagtccaattgaaagggcattacaaccaggcacggtggctcacatctgtaatcccagcacttcaggaggccaagatgggtggattgcttgagtccaggagttcgagaccagcctaggcaacatggcaaaaccccatctctacaaaaaacacaaaaaatagccaggtgtagtggcacacaccttagtcccagctactcaggaggctgatgtaggaggattgcttgagcctgggagttcaaggctgcactgagctaagatcacaccactgcactccagcccaggtgacagagtgagactcggtctcaaaaaaaaaaaaaaaaaaaaaaagagagacagagaggcctcagttaagtctgcagcttctgtcacttgttgaatcatctctagtcttcagaataccatgaaattagttttctcagaagtaaaacgatgagaaatacataacaataatgacattgcacttcatcattccatttcctaagacatttatagggccatggatggtgatcttttcaagagacaaaaataaacgcgggtgcagaacaggtaagtgcactataatttgagtacatcagcttttgggcattaaaatcgtgggtcagaaatttagagcaagagggcaggctggatcctgatagcaggagagtgtgtgtgtgtgtgtgtgtgtgtgtgtgtgtgttttgagacggaatctcactctgtcgcccatgctggagtgcagtggcacaatctcggctcactgcaagctccgcctcccaggttgacgccacactgagattccctagtagctgggactacaggcgcctgccaccatgcccggctaattttttgtatttttagtagagacggggtttcaccgtgttagccagggtggtcgcgatctcctgaccttgtgatctgcccgcctctgcctcccaaagtgctgggattacaggcttgagccaccgcgactgtccgagtgtttttcttttaactttccagtagcatcatggtgtttaccactgttatttcagagtgaagtgacaattttgttgtttggttggttttgtactttttatttttattataattactttttaagtcaaggactctgtctcccaggctggagtgcagtggcaaggtcacagctcagtgcagccttgacctctagacctccaaggctcaatggctcagcctcccaagcagctgggactacaggcacacatcaccacacccagcttatttattttttgagacagggtctcactctgttatccaggctggagtgcagtgacatcatcagggttcactgcaggctcgaactcctgagctcaagtcatcctcttacctcatgctcctgagtagctggactacaggtggacaccaccacacccagctaatttgtatatattttacaaagtcagtgtttcaccattttgcccaggctagtctcaaactcctgggctcaagtaaccctcctgccttggcctcccaaagtgctgggattacaggcagttattttgacaatacgattatgatggttaaactgagacgtgtgccaggaaggttagggtgaatcagacagattagataaacaggttttgcttgatatgaccctgagttgcatcgtgagtgcaatcaggaggaatacaggtgaaatttagcacaggatgtaccaatgggtcattacggtcaaaagtggtttgtggttctgagtggcaaacctggaaccttgtcaaatttcccacagaggtaatggtttgtgagattctgatcagagaattatccctccctgctgtaatcaaattagttagggacagtaaaacagaaatctgatcataagtattttgctatgtatgtatgtatatgtatatacacatacacacaataggactagtgtggcatatcttaagagaatatgcatatagggtgattttaccaaaaccaccaagagacaacccctacaacttaaaggagccctaatggtgtgtgtattccagtcaacaaaaaagagactaactctttcaggtgcagtgagcactggaattgtaactgattatacaggccagtatcttgggtgaaagcggactaccacagatgtcagctacttgccatctctgtcaggaagattgagttacctttaagtgaaaatctcctgacagatgttcactctggcagggttgccttttacaagagaaacatgaatccgtgtgtcaacgcacgtaagtttaatggcacagattggtcagtaatacctgttgtgagtcaggtgcagtggcccatgcctgtggtcccaactatttggaaggttgaagcagaaggatggcttgaacccaggagttcaaggctacattgagtcatgattgtgccactgcattctggcttggggaatagaatgggatcccatctcaaaaaaatgtataaaataataataatacctgatgtggtcccttccaacagtcttggggggaatattttatttggtgttgtttctagtaaacaacatctccaggttataggccgtgatttttagtattttcatctcccaggagtgcattatgaaaggaatcctttattaatgtggagttcttagtaagttttgagagatcttagcagtaatggagaaagtcacctttaagaagtgcagattcataagcgccttcatctaaccactgcatgggtcttccgttattatttcaaagagagggagtgtggacattttccagaaccagtgggagatccttggccaagaaaggttaaaaacttctgttagctttgccaactgagtttttattgtgtcattagtacattccatcggcccagaggattatgggtgacaggcacaatggaaatgttgggacataggcaaaacattacaaatggatccaattacctgaccaatgaagtgtgttcctcagttgctatggcattcagatggcactccccatgaggaattaccttttcttttctttttttttttttttttttgagatggagactagctctattggaaggctggagtgcagtggcacgatctcagctcactgcaacttccgcctcccagattcaagcaattctcctgcctcagcctcctgagtagctgggactacaggtgtgcaccaccacgcctggctaatttttgtatttttagtagagacggggtttcaccatgttggccaggatggtctcgatctcttgacctcgtgatctgcccaccttggcctcccaaagtgctgggattacaggggtgagccactacgcccagccaggaattaccttttctaatcacaatctacctactacttgggctgtggctcattggcatggaaatgctcaccccagtgagcacgtacaaattaacaccagaaagtatctgtgaccctgagatggagacagctggataaagtctaactgccatgtctcgaagggtcctaaagttaaaatgtccttgtgacccatgaaggggctttccagggtgatgtttgggacaaacagtaccacaagaataaaccttttctgcaatcataggcaatgattttcaataccattgctttccccatgctaacattttatctgatttccaatgaggcagcttatgaagtactgtattcagggtaattgaagcctaaggggtggatcagtgtatcattgggcccataccataagcctgtttctggaagaaacttgttccctttatccttccagagatccctctcctgcttaggagctcccacttacgcttctttttttttttgctagagtctagctgtgttacccaggctggagtgcagtggtgcaatcttggctcactgcaaactctgcctcccaggttcaagcaattctcgtgcctctgcctctcaagtagcaggaattgtaggcatgtgtcaccacaccagctaatttttgtatttttagtagaaacagggtttcatcatgttggccaggctggtctcaaactcctcacctcaagtgatccaccagcctgggccgcccaaagtgctgggattacaggcatgagccaccatgtccagcccacttttacttctaatgaagtcttcaatgggtcataagtcagcaaggtcatttcgagaagttctgtgtctgatgccaccttcagaactgcattcttagctgcagcatcagcaaaatgattgtccttgctctccggaatatctagttttgaatgaccaggaattttgatgatggccaaagataagggttttcaaattgcttctaagagatcagagatttattggtcatttttgatggcttgacctgatgaaatcagatacctatgttgcttctaaagcattccaaaatcatcacctactccaaatgcatctctgctcccagtgtaaatgttaggctgaggtggaaggattgattgagcccaggagttcattcaggtccagcctggaaaacacagcaagatgtcctctctacaaaaaaaaaaaaaaaaaaatcaaagaattagctgggcattgtggcatgcacctgtggtcccagctactcgggaggctgaggtgggaggattgctagagctgagaggttgaggatgtggtgggccatgatggagccactgcattccagcctgggtgacagagtgagaccctgtctcaataaatcaataaataaatcttaaccatttaaaatatcaatgacagatttgtttggccttttaagtgcattgctgaattctccaatctacatattggggaacaacctgggtaatggcaacatggaggtatttggcaaaaatgcagaccctttcattgtctgcttctgtctgtttttaaaaaccctctaaaggattattccaattcaccctttccaaccatttagtggccctgccttcttacaccaacatgtgaattaattgataaagatcagaatatccaggctcaaaagtttggacaattaagtcaaattttctcctaaaccctataggatcttggaggttgcttttgaattagaaagggaaaattcagctgggtgcagtggctcacgcctgtcatcccagcactttgggaggccaaggcgggtggatcacaaggtcaggagttcaagaccagtctggccaagatggtgaaaccccctctctactaaaaatacaaaaaaattagccaggcatggtggtgggcacctgtaatcccagccacttgggaggctgaggcagagaattgcttgaacccgggaggcggaggttgcactgagcagagaaaaaaaaaaagaaagaaagaaagaaggggaaaattcatgtaaattttcatcagggaagtcttttttttttttttttttttttttgatacagagtcttgctgtgtcacccaggctgagtgcaatggcatagtcttggctcactgcaacctccacttcccaagttcaagagattctcctgcctcagcctcccgagtagctgggattgcagtcatgtgccaccatgactggctaatttttgtatttttagtatagatggggtttcaccatgttgtccaggctgctctcaaactcctgacctcatgatctgcctgcctagtcctcccaatgtgctgggattacacgcaagagccactgcgcccagcccagggaagtctttttataatattcttaattcacattttggtgaagcagtatacagaatggtaggctcccctcttcctgtgggttttaccttgaaaggggctgtcagaacagaagtttcagggaaggggccagagccctggggactttcctcaggtgatggtgatggaagaagaggcaaggcaggaccagagggctcaggtaagggagactatgcaggtgcaggggcaggaggagaagcagcagttggaggcgaaagagacaaagcctcctcaatatttctcaattcagaaaacgtgtcagatgacttccttcagcttacttcctcactggaggcaattttctcagttcttttagaaatttctaggtatcattggaagtatgtctcccatttaatttggttctaaaaccaaattttttggccaggcgcggtggctcatgcctgtaattccagcactttgggaggctgaggtgggtggatcacgaggtcatgagatggagaccatcttggccaacatggtgaaaccctgcctctactaaaaatacaaaaattagctgggcatgctggcgtgtccctttagtcccagctgtttgggaggctgaggcaggagaatcgcttgaacctgggaggcggaggttgcagtgagccgagatcatgccgctgccttccagcctgggtgacacagcaagactccatcaaaaaaacaaaaaacaaaaaaacaaaaacaaaaattttccaattgtgcacactaataaattattttaagcatttcaaaagatcccaattttcttcattctgcttatgacttaggaaatgaccaggaaatggttaggtgggtccagtttcttggatatttacaagaggatgcttcataagtgttatacataaacccagctggtgtttctaaaggtggttgtttcttcacagtgtgctgaattttgaagcttgatttcccataattcaggagcttttcagatgaccaaggcctgcgatgtgttttgggtcacagtgtggtgcttatgaagtcactcctacagataacaccggagttgtgtgtcactgtctcagtggttccactgtttctaaccaccaggtggccacagagtcccacatatatcctcccagaagagcaggaaagggggttgataaaagtgttcttctgatgggaagtgtcctataaggccaccttcacatggtgactaatgaccccaacacctctgcaacatccccgatcacttggagcacctgaatggatcagcgggagcagatcacttcttttcttcagggcaggggaacacacctccatgcactttccagttaagaactaacaggaattagtcacaaatgaaaacctaagtccaaatgttcaaaacaacatgctacataaaacaaaaccaccagggcctacctgccaataccttgacccagaacttcctgctgaggaatagaggcagaaaaggcagaagctctctggggagctctttgcctgactgtgacccaaaccttctgtcctgatgcagaggtggaaaaggcagttatttccccctgaaacacaaatctcttacccacagggtaaagacagaaaacctctgttctagaaagggagagctgaaaaggacactcaagcaaactccaagacttcaatcaaccagtgtttctctcagagtcagtactcgaaggcttcagagctggccaggcacccagtccaggaggaatgtggtgtgatctgagagatgaaaatacatgcccccttatagactaagacagactgtaaggttaaggaaacaaaagttagctacttgtccagggttcagggctcatctggcatggcaacttcctgaattcctatggctacaggaaaaaccacactcttgctaaactccttaacaataggagctagcaagcaaattgtcaaaatcttcccagcccttctcaactggatttacaagccagatcactagagctctgatgggacagaggagtggccttccattctttcctaataagcaactgcagatatcaagccagtttcagccatgttacagggactgcacacaaaccaacttcatgtccagtagttcaccttttgatataaagagccaatttctgccttattttatgctaaaatcccttccccatctgtgaagatggggtgcatgttacatatatgtttacccattgcacatgagctcaatactcctcagaaatggtgtttccccaaacctactgaatatgtatgactctattgtgtgatacacaccctgtgaggcacaaaaaccaacctgccctctctctctgtctctgaagagaaagtgcctcttcaaagacacacaccggagactgtcacttcctggactgcaaacttatatcaccaataaaattcttactactatttagccaccctggaggcctttgagaggacagtcagatggtcagagatgagtcagtctgaatcctgctcccagggccaaaaacattgacatagaaggaaggcgcttaagcacaaaatatgatttaaagagtttgtttgagccaatgtgaatgtagttgcccggaaggctcagacccaaacaatattggatatcggttctatttggcctttgttacaagcaggtttgtaaagaccaaaaagggagtcagggagttggctggtaaaaagttgcttgtcaggaactcccagtggtttacagaaataacattgattagctatacattgttcagctacagggagtgagagatggtgtccagagcagcatgtttaggttactttatagctaactgtggcaatagcaagcagtttcagtggatgcatacatagctcaaaagtggggaagtggccggtggtggtggctcatgcctgtaattccaacactttgggaggccgaggttggcggatcacctgaggttaggagtttgagaccagcctggccaacatgaggaaatcccatctctactaaaaaaaaaaaaggcaggcgtggtggttcgcgacgttagtcccagcaactcgggaggctgtggcaggagaattgcttgaacctggctggaggaggttgcagtgggccaagatcctgccactgaactccaacctgggcaacagagtgagactccatctcaatacaataaaaaaaatattttttaacttaaaaaaatttagaaagcaggaagtaggatgtggttgctctctcattttaatgcctagctttaggcatgctaaattgaaagcactcattttcctcacatgaaaaattcttttcttttctttctttcttttttttttttttttttttggagacacactctcactgtgccacccatgctaaagtgaagtggcatgatctctgctcactgcaacctccacctccagggatcaagcaattctcatgcctcagcctcccgagtagctgggattacaggcgctaggcaccatgcctggctaatttttgaattttagtagagatggggtttcaccatgttggccaggctggtctcgaactcctgacctcagatgatccacccgcctcagcatcacaaagtgctaggattacaggtgtgagccaccatgcccagccaagaccattaatttaatctatagctaaatctattcgtttttcatgttacaaattcaacaagaaaaattttccctaatgaaacatcacatttaaagctaagtagaaaaaaaatgtaatagtgccttgctgtgtcatccaggtgagagtgcactgatgtaaccacagctgaccagcctagaactctgggctcaggcagtcctcccagctcagcccgccttctaattttttagagacggcatcttgccctgttgcccaggctggtctccaactccttgcctaaagcattcctcccacctcagcctcctgattttctgggattacaggtgtgagtcaaccagcctggcattgcaggaaaaaaaaagcccataaattattctttattttattttattttgagttgaggtcttactctgtcacccaggctggagtgtggtgttacaatcatagttcactgcagcctggatctcctgggctcaagcgatcctcctgcctcagcctcccaagcagctgagactacagacatgagccactgtgctggctagtttttttaaattagttcattttttaaaatttgtagagacaggggtctcaccatgtttcccaggctggtatcaaactcctggcttcaatccttcttctctcctcagctgcctaaaatgctaagattacaggtgtgagccaccacaccctgcttaatttccatattttaattttatatatgtaattattactgtctttaagataattggggcagtaatctctttaaagctttagggacttaatttatctattcactccactggaagagtatgacaattggtttcataagaaaaaaatttataaattagaaaatttctttccaccaatctagggggcattcaaaagcaaataattgcgttaagtaacatcatttaaggtgaaaacagatgcagtggtatctattaatgcttatcagtaagggaaacaaactgaaaaaatgaacatcattagatccttggaaaaccctcattgctgaaaatctgagtgattctgggatacccttttgagtctggcagggcattctctttccggagcatataaaagtgagtaaatcattttttttaatccattttcattaagagctgaacttccttaattttctggagattattaaatttgatttgtggccaggagcagtggcttacgcatgtaatcctagcactttgggaggccaaggtgggcagatcacttgagttcaggagttcaaggccagcctggccaacgtggcgaaaccccatctctactaaaaatacaaaaattagccaggcatggtgttgcatccctgtaatcccagctactcaggaggctgatgcacaagaatcgcttgaacccgggaggccaaggctgcagtgagccaagatcgtgccactgcactccagccttggtgacagagcatgactctgtcttaagcaaaaaaaattttgatttgtagagtttagagaagtgcttatgttgctgactccattgcttatttgtgatcatataaatctcttttctcctttctgtagtgtgatttaaacgtaatccttaaaggacatatatttcagctggttagagttttttagctggtagaaaactgagtgtatgaatcaaagaaaactgctcctttcatgctacagacttagttttatttctgtactaagatttcttttaggtatagtaatctgttaaagccaagagctcctatggaatgaagttcagtggcgggttacggggggcattgagtagtaagatcatctttataatagagatgccactcttgcaaatattgacagctattgagcccaaaaaattgttaccaaacattggaaagacaagatatgagcaacttctcattgctgcagtctcaaatatcaggaaataccattatcctcaggacaatgaacagaccatcaaaagagactcacagaccagatcagctctcatatatcaccaaacagggactggatccttgtcaaacaccacctaacagagattgtccccagaaattcacttcataacatcaaaaccagaaacccacactgatgccactgatggcagaaaacagtgatggaagaaagagagagagggagatagagaaaggaaggacttgctcaatgaccatacttagtatataaaaagcaaaacagctcaacttctgctcatgaaaacaagaaccaagggaacaagagccaatatctctaaggatccaggtctgcaccaggggcctgttaggtgcaggattctgttggctccaatgatgggtgtcagatggattaatttttatggacatagcctctgaaagaaatccgtcgaggctaataatacggagacacttgtctgcatgctcattctccattaatatagaaggaaactggcattagattgttttcatcaaataaaagtaaaatcaagatttataaagagaagaggaaaggggaggagaaaaaaaatgactgggaccattgtgattttgctccctttggataagcaacttggcagaaagctatcaaagaggtcactgtgacctgtcttctctggaccaatgtgacttggtcatcacaggaaacaattacaggctgggcacagtggctcatgcctgtaatatcaacactttgggaggctgaggtgggtggatctcttgagctcacaagttggagagcagcctgggcaacatgatgaaactctgtctgtacaaaaaatacaaaatttagccaggcatggtggtgtatgctagtagtcccagctactcaggagtctgaggtgggaggatcacctgagcctggggaggttgaagctgctgtgaaccatgattaaaccactgcactccagcctggatgacggagtaaaaccatgtctctaaataaataaattaaatttgaaaaagaaacagggccaggcatggtggctcacacatataatcccagcactctgggaggccaagatgagagtatcacttgagctcaggagttcaataccagcctaggcaacatagtgagaactcatctctaaaaaatacatatttcttaataaatatatacaataaaatatataccatattttattatacataatatataattgtatgtatttattatcttaataatatgtatatatttattaaatatataaaataaaaaagaaacaattacagacgttggaggactttaaaatatctcagccaggtgcagtggttcaggctggtaatcccagcactttgggagactgaggcaggaggatcacttgagcccaggaggctgaggctacagtgaactatgatcgtgccattgcactgcaacctgggcaacagaacaagaccctatctcaaaaaataaaataaaatgtcttagaagtttagctgtccatcctatgcaactgaatatctgtgtgtaatgtccaccatgtccttctgtttaacctcccccttacttaagccagaaaggcatttgtccccttattagaatatcattggcacatggctgggggtggtggctcatgactgtaataccagcatgttgggaggctggtcaggagtttgagaccagcctggccaacatgatgaaaccttgtctctactaaaattacaaaaattagccgggcgtggtggtgcaggcttgtaagctgagatcacgccactgcactccagcctgggtgacagagcaagactttgtctcaaaaaaaaaaaggggggggggaagaaaagaatatcatgggcacatgtatagaaagtttgttaggctgggcgcagtggttcacacctgaaatcccagcactttgggaggacgaggcagatgaatctcttcagcccagaagttggagttcctggggccaacctgggcaacatatcaagatcctatctctaaaaataaaaaaaaaaagttggatttgatggtgcacacctgtagttccagctcttctggaggatcactagtgccatggttgcaggggcggtgagtttgcagtgacatgagatcatgccactgcactccatcttgggtgatagagtgacacctagtctcaaaacaaaaagtacgggaggggagaaaatttgttgtgtcagcaagtaaatgaagaaagggacattattagagttgagaaataaactggaatgtgatttggtacctctcccgcagaagataagtttgctaaatgtgctgaaattagaagcattgtataaggccctgtgcagtggctcatgcctgtaatcctagcactttgggagacctcggaggtgcccgagcccaggagtttggggaccagcatgggcaacataatgaaaccctttctctacaaaaaatacaaaagttagctaggccttttggatgcgacaactgattgtgccacagagacacaaccctagtggcttaggactctgggaagatataatctccgccgtttatctagtgattgataatgcatgaacgctttaaaagctgaagcaggcagccgggcagggcgcggttgcttacacctgtaatcccagcactttgggaggccaaggcgggtggatcacgaggtcagctgatcgagaccatcctggccaataaggtgaaacctctgtctctactaaaatacaaaacattagccgggcggggtggcgctcgcctgtattctcagctactcgggaggctgaggcaggggaatcgcttgaaccagggaggcggatgttgcagtgagccgagatcgcgccactgcactccagcctggcgacagagcaagactctgtctcagaaaaaaaaaaaaaaaaatctggaggaggcatccctcagtgggctctaaccaccaacctctagattaacagccgaacaagctaaccgattgtgccacagagacaggtattgtaccttcttctgggcactataggaagggtgcactcaccaaacactcccccaaccgtcccaacctcagagcccaccagacagtacaactgtgcaaggctttggaaaactgaagagattagagtggtgaatcgtgttagtctcattggagatccgcaggttgggagattctggaaccaggacgaccttgcccctcgccttcatcaaaagctgccggaaacgccccggccccgacacatacctgaaccgcctgggggcccaagggaaactgaaaggccggtgggctcccgggatggctcttcccgttctttgcgcctccttcacccagtgagggagcctgtgcccactctgcccagtcacttttgaggccgctgaggaacttccgctgccatcttcggatcctgtgtcccgcacgggggctccaccagggcagggatcgtggtgagggtggctcatgggtcccctcgcggggagcagggtctggcactcaccagggcgcacgactaggacttgttgaattaatccatcctcgcctttagcttttaggcctttgaagagccctgaaaatggaaatcatgaaatattttaccatggggaacttttgatttgctttttgttgtttgtttgtttgttttgtttgtttttgagacagggtctcgcttggtcgcccaggctggagtgcagtggtgcaaacacggctcactgcagcctcgacctcccggggccgtcgtcgcctttagcttttagtcccttgaagaaccccaagaatagaaatcatgagatttttccatggggaagttcttttttcaaagcgtctattcacgttgatttctaggcatcccccagggagggcaacgggcagggcctccagtgcaccttctgcgcggtggagccgcgggggctcagttgggcagtagtagggatcgtggggagggagggcaggagcgggggaagagaaaagcaaaagcaaggaaagaagccggggagcggtggaacacacatccggacctcctgaaaggctggtgcagaggcacaggctggatctggaggtgagaattgttttgttgttgttgttgttgttgttgttgttgttgttgttgttgaagcagaatggggaggaactgaggggaaaattcagagacaacatagaagagcttcaaacgcgaggacctataactccccaagaataacatcttccagggacactagacagaaaactaggcatctgggaaccctgaaatccctggaggagtagcatcatcatgaccctctgtgttccttttggcaaaaggacttgcttcccttgtttgtacaattgtttgtgtttgttaaataaataaaacccttttcatatatctttgaaagtatattggctctattattttatgattacaaataatgctgcagtcatcattcttgtacacttctcattggccactggtgtgtttctacagggtagaggcttggagagcagttgctccagcatagtgtttacatattttttatatcattccattttctttccttttttggcttattagctgtaactctttttttcttcttgtccaccgctccccgacttcttttcctgcttttgctttttcagtgatggctttagggttttcagaatacatctttatcagtgccgtctagtgacattctacctccccttctggctgttatgttagtgttgttatgtaatttgattttagacatgttataaaccccagaatccattattatttcttttgtttaattggtcaaattattttaaaagatttaaataataagaacatatatatttaactatgtacataccaattgccactagtctccatttctttttgtagatccagatttctgtatggtatccttatccttaggcctggaggaatccttttgcatttcttgtagtgtgggttgctgaattctttttttttgttttgttttgagatggagtctcaccctgtcacccagattggagtgcaatggtgcaatctcggctcactgcaacctctacctcccgatttcaagtgattctcctgcctcagcctcctgagtagctggaattacagacacaccccaccacacccggccaatttttgtatctctggtagagacggggttgcaccatgttggccaggctgggttggccaggctggtctcgaactgctgacctcatgatccgcctgcctcagcctcccacagtgctgggattacaggcatgagccactgcgcccagctagaattctttcattttttttctatgtatttaaatgtcctcattttagtcacattcttgaaagaattttcattttggcatagaattctaggaaaactttatttctttcaacactttaggatgttgccactttgtttttgcaaaactggcataaagtgggcttcttgtacttgttatataatttttggaatgtgtatttaaattaataacataaaatggggtggactgctgggcgcagtgcatcacgcctgtaatcccagcactttgggaggccaaggtgggtggatcacgaggccaggagattgagaccatcctgctaacacagtgaaacccagtctctactaaaaatacaaaaaacttagccgggcgtggtggctggcgcctatagtcccagctactccggaggctgaggcaggagaatggcgtgaacccgggaggcggagcttgcagtgagtggagattgcaccactgcactccagcctgggcgacagagcaagactctgtctcaaaaaaaaaaaaaaaaaaaaaacggctggaagaggtggtgcacgcctatagtcccagtactttgagagggggaggcaggaggatcgcttgaggctcagagttggagaccagtgtgggcaagatagcaagaccctgttctctgtctcatgtatatatatatatatacacacatatacacatacacacacacacacacacacacatacataaatcgtgaatgtcctagattcatcttaagttccaccaacagtacacttaaagtaaaatgtgcccaacctgagggtcaaacctacctgctgacgtgcagtttgtgtttgtgagacattctcaacagcatttgctttccctagcatagtggttttcatgttttcctcacacctgaatgtcttaagtgcaaaacttgtcagaaataatttcctttgccaaaagattctaaaatactttttttttttgagatcagctcactgcaacttccacttcccacgttcacaggattctcctgcctcagcctcatgagtagctgggactgcaggcctgtgccaacacacccagctaatttttgtatttttagtagagatggaattacatcatgttggccaggctggtctcaaactctgtacctcaagtagtgtgcccacctcagcctcccaaagtgttgggattacaggcgtgagccaccatacctggcctaaaatactcttacttcaagtaaaagtgcattaaaaacaaacttctcatttgcatccctggaatctatagaaagcccggggagacaatcaagtgctacaggatcaagcgctaaacaggggaggacaaagtgtggcttcctcactaggagtcagggcaaagttaactgccttggtttccaatggagaccagaactcggttcccctgtgacgggaggacgcagcccagaggaggccgactttctcttcatggtgccttcagacaggaaatctcctaggatttctttctttccctttgatctactcccaatactccctttctgtttcttcaaggtcttttttggatccctactgcacaggacctaaggggctggtgcccttccctaccctccctgcctgggtgtcttcagcacccaagctcacccagaatgttattgcctgccagagacagtgagaggaccaaggagggcagtgggtgcagtggaaccacagcgtcaccatgtacctgtgcctcgtgggatctgagcaaattgaataaacgccccctgaagcttttctgcaggtcacagggaaggggagggtggctgctgacccagcaagagaagcatcaggaagcatcgggggacctcactgtacccctgtaccttgaagacaggcctggctaggctgattttaatgggtaggccgaaggaaaagtctcaatggcaacccaacccccgaccctgagattacagctttcaaatgtctgattgttttgatgttggtcagtagaatccatcccacctttatcaggagactcctttgccaaaattctgagatctgggattcctgctggttgctgcacagaaagccaatcaccaagatgattattgccaaggaaggcactttaatagggtgctgcagtgggggagatgagaactcaagtctcaaatctatctccctgaccagccaaaaccagaggtttagatggcaggaaagaaatgaacaatgtgtaagaaaacaggaactagggagcagcaaggaagcaatcatgatgaacgaggggtcccagcatctcactgtctggatgaatttcagttctttgatagcttttttgacagtcctgaaggtcatttcctgaggaaggaactcagataaaacaaatattaagtttcaagctttaagaccagaagggtccatttctaggtttatccaaaaaagctacatgtgggactgttgggtggttttcagatcaagaaagaaaaagattgtgcagaccaaagtctgaagttaaccaaagaaaaaacaattttctgaccaataggatgtataggatcagagaatgacaagcctatagaagaactgtttttttgtcctgagcataggggaaggatgaagctgcaccagataaggtggaattaagctgcagatgggcaaaaatctgaattttggttcagagccctggggtcttcctcaaaagtctccttccttgaaagaggaaccctgtcttggtttctgcatctctctgagtccttttggaggttgaggatgctgaggtcttggtgcttggccccctctaaccctgagtacttcccctcctgcagggcaacctggccaagtacccaggccccagctccagcgaccatttccccctactttgctcctagcaaaggctatttctaggtcagtggtgaggcacaggcaggacagggcaactcgttctgacatgttttgccctggaaggccttgagcactgcggtcctgcagaaccactgtctccctcttttggagaaagcagggaggaaatgacctgtgtggagggaatcgagggctgcacctgcatggaggagctgaggcaagcagggcagttccagtctgtaaatgtaaaggacatttgtcatccaagaggttgggctgttattattaattttgaattttgtcaaaacaagcttcagggaaattagtcgtcttacttgtaagaaccttacaagacctcccatcttatattccagggagaattgctgcgtattacatgaacacataggtgagactgctgttctgacctgcaggacttgatgccctggcgcaggggcaccagggtaccggcaaagcctttcccatacaaagagcaaggatgttatgtctacaacccatcggcaccagttccaagtacaatttctgctcgactctatggactgagtacacattccccccagcacagaaatcctacaaactcccatgaatgctatagtgaaaagcaggggctggctaggtgtgatggatcacacctgtaatcctagcagtttctaaacttgagtctaggagttggagaccaacctgggcaacatggcaaaacttcaactcttaaaaaaacaacacaaaaaaacaacaaaacaagcacagaaattagccggctgtggtggcttgtgcctgtgctactccaagggctgaggtgggaggattgcttgagtcaaaatgccaccagatacagtgagaccctgtctcagggaaaaaaacaaacaaacaaacaaaaagaggctgtgtaagaggtcaacagaaaaacactaaggttttcaagtggtgttaaaagccagtgggccttggggaccattgagcaatctacaaagcagggaagcctagatccctgagctccacctgccaagtaccaccacagctaatgtgagagacctcccccacagagactgaaatttgcctcccgaggaaacaagtgactacagacatctgtcccaggataataaaaaagaaaacaaggtctcacaaaaacaaaaacagctgaccacaccatacaatcactgagactgagcctgtgactataggtgaagaaaaaaaggctgtctattattcataccatgaaggaccaggggaaagtgcgaacacagtcccctactactgttgtgggaatcaggagaacagagagaccaatgggtggaacaggaggactttattgagtgtactcaggcccagcatattaaaatccaaaggctgagccctgaacaaagacaaggcttggcttttacacacacttctgaaagggggttggctagtttgaatggcgcagtgggaatttgaaggtgcaaaactcacggtgcaggcaagagggcttacagaagcagaacaaaggcagctaatcaaactgtgaccggtcttgcaatgcaagcatagctggtgaccttgcagctgcactgacaggaaatcaggaacttaaaacttgaataataagaaatggtaaggggaaaagagaaggtagtaaagggatttgttgttttttcctcttatccttgctaggggcagactgtgttgagagagtctctggaactaattcctcagggctctggcttttcagacagtgttatcaaggatctgctagggctctatctattgctggccttggagtcagtcaagtactgtgaagctcagttatgcagctgagcttcacacattaggggagataacagagaacagcacatctggagtgcaatggatgagcctcaaccttaggatgaaccactattggtgaccataggatttcccctaccaggtaagtggcagtccacatacctctgccccaccacagctccatatgcctcacctttacacgcatggtcacttgctctgagaaccacccccaccaatctccaaccaccctgagccctcctagccctaacacacagctgggactctcacgtccacccagcagtcctggacttgctcctacagcacgggaaatcctccatggtgaagaagcagccctgtgctacctcatctacatagaaatgccctatcgatgatgtcaccgacaatacctttcttaatgttctgaagattattaaattagatttgtatagttgtgaaaagtgctcatattgctgattccattgcttacatatgatcatataagtcttttctctcctttctgtagtgtggtttaaacttaatccttaaaggacatgtatttgaatttttcagctggttagaaacctgaatataccaatcaaagaaaactgctccttacatgctacagatttggttttcttcctgtactaagatgtcttttagatatagtaaatttgttaaagccaagacttcctatggaacgaagtttgatgggaggggggacattgagtagtaagatcactcttgtaacagggatgccactcttgcagatattgacaactattgggcccataaaatttttaccaaacattggaaagacaagatatgaacaacttatcattgctgcagtctcaaatatcaggaaataccattattctcaggacaataaatagacaataaaaaaagtctcacagagcagattagctgtcatgtattaccaaacagggattggatccttgtcaacaccacccaacagaaattgtccatacaaattcacttcataacatcaaaaccaaaagcccacactgatggcaaaaaataatgacgcaataatgagagagagagagagagagagacctgtcctatagccatacttagtgtgtaaaagccaaagagctcaatttctgctcatgatacttaataaaacagacggaacatgagccaataattcagtgggttcagatctgcaccaagtgcctgttggatgcaggattctactgtctccaataatatgtctcagatggactagtttttttttgttgttttgttttgttttgttttgagacagagtctcgctctgtcgctcaggctgaggtgcaatggcatgatctcagctcactgcaacctctgcctcctgggttcaagcgattctcctgcctcagcctccccagtagttaggattacagacacaccaccacatccagctttttttgctttttttgctttttttttttttttttttttttgtatttttagtagagacggagtttcgtcatgttggtcaggctggtctcgaactcctgacctcagttgatcagaagtaggtgaggtcagaaaacataccctgggaaatgctggcacaatgcccagaaccgccatctctaggcctggggttttcttttgtagtggaatactagtattcatgcaatgcagggacaagaccaattagatacttctgggagttaaaaagagatgaatttacagtgccatttgagaaggggtattaaggaatttgccagggtactgacgcgtgtcaggtgcaaactgcaggttgaaagagagctaagtattttctgtccatgaaggtgataagggagggcctgaagaaagacggaccgggaaggacactggcgccagaagtaggaaagggctgcttgggggtgggaaggatgggtcggggtgctatctaaaaagttgcctggcaatggatgtaggatatggaagcgagacatcaaacaagaagttgtcatttaaataaagtctgaagaaagactagatatgtaaacagcaggagataatagggaaactggaccccgctgctcataaaacttcctgccttatatttcagggaggatcgcagcgcatttcagccaagacaagtaagactgcggttctgacctgcgggcctccacgaattgcattagggcacctgggctccgggaaagccattcccctacacaaagtaagcgtgttatgtctgcaaatgaacggggacactaagagccccaaaggccctgctttcatcccaaagaacagcgcctgtctgcgtagtttgtacctggctctatgaggtgagaacacattccccgctagcacagaaatcctacaaactcctgagggggctgcggttagaagcaggggctgtgtaaaaggtgactctgggggctagagaaaaccacgaagattttcacagagcgtgagaacccaagacactggagaccatggaccaatctctgcaaaaagcagccctgcgtagaaagggaagagctgtacggccttcgcgctagtttgtttgtgttaaggctgacgctccctatttctcctcagtgggagaagcgacatcttaattcctatttcccagccttccactgtaagaataacacgtccaagacacaaatcaatgaaagaaaaaagtagcccttagagtacagcgtattcttgaaactacaaaaaatcaggggaaagcgcgaacgcagtaccactaccacaaattatgcaatcgagtttcccacatttggggaaatcgcaggggtcaacacatctggagtgcaatggataagcctcgccctgggaaaaccaccttcgtgatcatgttatctcccctgccaagtaaatatgagctcctgcacctccgccccgtacgcctcaccctttacacgcacggtcgcttgccccgcgcaccccccagccctcctagccctgacacacagctgggactctccggccggaccagcggtcctgagcccgctcccaaggctcgggaactccttcgaggcgaagcagcaggtggggaagcagcagctcctgcgctgcctcatctacatagaagtcgccctatccgtgatgtcaccgacagtgcctttcccaggccccatctgcctttctgccagtcagccgaccaacccgctgcctgaaccagcaagaggaagtgacgtctgcctctccctttttccctcccgccccggcatctgttttcgcccaaagaagctggtccttagcctatcttgtgaagcaaactttcggtggccagatggagcctgggtactcttcttcacataatgacttttatttcgcagactagaacgtttaggactacaaaagaaaccggttttcttcacatacttatccttgtaatgtagcattccgcttgaaattggaagccgttcaatgtcacagagaaaccatatttatgaaagtaaagaggcttctcagatgactgcaaaccagccttccttactgattttatcactggtaatgttataaaaacagttgtcaagtttaatgaatcttgtagttttttttatttttatttttatttttttccaaattcagtattgtggaaaaatatgctgccacagaagaaatgattggacactctcaaatgtggtgttgcactttgtcatcttttgcacagccatctccagaccttattgcttacctcgtgttagttttttatattctgcaaagacaaaaccaaaataatccaaatttgacaaaaatacctgggatacatcttatttgtgatgcttaacaaatgtctggatcatcttttcttatatgggattataatgcaggaaacactgtgaagtaagcaaagttggaattcccaagtcaaagaccatttgaatatttacaagtagatttgagacaggaataatacagggtggtcacaggataacaaattctaggcagcagatttacatgacttgaggctatgggctgataagatgctgaaaaaccagggtgtggaccaagctggctaagactgactggacccaatgtggtgctggatttgacgtaggttttacctaggccctcattatacgcttattaacatactaaatcacacacccaccagtgccatgacagttctgagaccaatatttgatgtaaaaatggatggcaccacagttctgagaaatctccacctttacccaggaattttcatcaatattccactccttggttaaagaaacccattgagatgaaaccccagaacccattgttctctctcaggtatgcccaaactcccctttcttgagtgtgtactttctgctttgcaataaatctcttctttcactatttgctaactcatccttgacctcattcttgagatggtgtcaagagcctggacaccacagctggggtcgagatcctaccagtgtccggggacctcccccagcccaccagtatcagattctattccattgctcaaatcacaaaacatcaaatggagaattcttctttggagaccacaaagtaaagattctgtggcatggtggccagttaggccactggaagacatggcaaaatattgaaaatgagggattaggtgacagcgtagtaactgctgaatgtgaaatacttgatccagaccccattccctgtagactgactgggagacacattgtccaggtagtagtggagaaatactttctgggtatctgaccagcctttgtggaaagaactggcaccatcctgcagatgtaaccacctgatgggttcttcctgcccactgtacacacaaaatcaattcacggagaccatggcattgcagtaaagagtttaactgacacaggctagccatgacatgtaggggacagagttattactcaaatcaatctcactgaaggcttggaggtaagggttttttcaaagacagtttggtggggagggggctagggcttgggcggtgctgattgttggggatgaaatcacaggggtgtggaaaatggccctcctgcattgagtcagcttctgggtgggagctaagggactgattgattttcgggccaaatggtgccatccagtagtcagaaatgcaaaagcctgaaaagacatctcaagaggccaatcttaggttctacaatagtgatgttcttcacagcagtaactggggaagctgcaaatcttgtgacctctggaataatggctggtgattatttaatgaggcatacatcttagtagaattcaggtccctttcatcctcctaacttggtggcctttcattagttttacaggggtaatttagctttggggaaggttatcattttaaccaaactttttggctgtccccagtgtttttggcaccagggactggcttcatggaagacagtttttccatggaagggggtggtggatagtttccggatgaaaccgttccacttcaggtcatcaggcattagttagagtctcataaggagtgcacaatctggatccctcacacgcatagttcccaatagggttcaagctaatatgagcatctaatgctgatgctgatctgacaagaggcagagctcaggtggtaatgctcgaaagcctgcagctcacctcctgccgtttggctgggttcctaacaggccatggaccaatacctgtcttgtggccctgggggtttgggacccctgatttgaactataaactcaatttttcccaaaaatagcttgggagaaattgtgcaggaatgagcaaagacagctagcctgtgaggctagaaccaaaatggagtcagccatgtcagatttctctgattgtcataattttgcaaaagtagtttcagagggactaccctgacacttgttaaaagcatgaggcggattttattgtatgtactacagtaggcaagagagaccagcagagaaccgagctcaactccaaatacagcaagaagggttgaagatttatagccaatcggcaaggtaagaaagtcagtggatggaaaattactaagaggaacttgattaactatcaaaggtggttgggaggactcttgctaaactaggctcaacagtattcttttctaaaactggacttggcaggccaagaactaatagagaaaagggctcagaggaaactgactaaggtttggtcaaagatggagtccttgtcaactctacattgaagtttctgcaaataaacgaagaccaaccaaatgaaaaaaagtaaaggctatttattctgagcttgctatagcagggagtcagccactgttacttgtgttttggcagagacttgaaggcagtcagagaagtgggaaagctttttacaaagaaaggcttcaggtatgcttcaactggaggctgtcagcatgatgaagctagatagatgaaaaaatcaaaatattttaccccagaatatatttctttggcatattttaagatggccgtcagagagccagcaacagaagtaactctgcaaaactgtcttttataggggaaatttacacctacagagaatctgcattaatctagccttcccttgtcaggattgagaaataaaaataagccctaggccctacagccaactgaacagactccctcttggctgacaggaccgcagagaaaccttgaaagctgtttctggctgtggcaggatagaaggctggacatgcccccttaaaacccctccctcactaaccgcggttatgaggcaggagaacagcagagggagttggaagttggataaaaggcagaatgagtaaaagcagaaacagaagtaaggtgatggggtgggagagcaagaagcaagataaaaggcataaactaagcaaccaaaacaaaaagtaagattaaaaaaagcaagcaaggccaggtgcagctgctcacatctgtaatgccagcagtttgggaggccaaggcaggtggatcgcctgaggtcaggagttcgagaccagcctgaccaacatagtgaaaccccttctctactaaaaatacaaaaagaaaaaaatagctgggcatggtggtgcactcctgtgctcccagctactcaggaggctgagacaggagaattgcttgaacccaggaggcagaggttgcagtgagccaagatcatgccactgcactcaagactgggcaacagagcaagaccctgtcttaaaaaaaaaaaataaaacaagcaagcaaggaccccatggccagcaagatccaaaccaataaaggggcagctcttcagagataggcatgtgcattagagagaaaaagtatccttaacatgacttcatatgataatcagctcattaaagctcatgcatatggactgcatatcatgcatgtacttaaaattatgggatagaggcaacattcaagcacacaagggccaaagtaactaagcaacccacctatcaatcaaatggcaaaccctggctaaagattaggcattcttggcctggcacggtggctcaggcctgtaatcccagcactttgcaaggctgaggtgggcagatcatgaggtcaggagatcgagaccaccctggctaacacggtgaaaccccgtctctactaaaaatacaaaaaaattagccgggcgtggtggcgggcgcctgtagtcccagctgctggggaggctgacgcaggagaatggtttgaacccggtaggcagagcttgcggtgagccaggattgtgccactgcactccagcctgggtgacagagcaagactctgtctcaaaaaaaaaaaaaaaagattaggcatccttgtgaagaaaaaaaaaccacacatcaaaagacccaatgtacaccaaactaatactgatctcatctcccagaggtcagcccactctccccactccgagagtgttactgtgcttaataaacttttgctttgctttgctgctttgtgtgtgtcatgtacacttctttgggacaccaacagtctggaactgcacggtaccatctggtaagaattaggcttttttggccgggtgcggtggctcacgcctgtaatcccagcactttgcgaggccgaggcgggcggatcacgagatcaggaaatcgagaccatcctggctaacacggtaaaaccccatctctactaaaaatacaaaaaattagcccgacgtggtggcgggtgcctgtagtcccagctacccaggaggctgaggtgggaggattacttgagcctgggaggtgaaggttgcagtgacccaagcttgcaacactgcacttcagcctgggtgacagaggaatgggccttcactagacactgaacctgctggcaacttgatcttagactgaccatcctccataactgtgagcaataaatttttgttgtttataagttactcactctgtggtattttgttatagcagcacaactggattaagacattaacctgaccttaagaaatcatctcaaatcagtcttggctttgatgagaaacaaagggcacactcgaatgtgtgatttaaagagagttttttttttttttgagatggagtctcgctctgtcccccaggctggagtgcagtggcatgatctcggctcactgcaagctccgactcctgggttcacgccattctcctgcctcagcctccggagtagctgggactacaggcgcccgccaccacacctggctaattttttgtatttttagtagagacggggtttcactgtgttggccaggatggtctcgatctcttgacctcatgatctgcctgcctcggcctcccaaagtgctgggattgcaggcatgcgccactgcacccggcctacagagagttttatgaagagaatatttataaatatatggacaggatcaaaataacgcaagaaaggactgagaggcactcagaatctggaatcatcagagaagttgtattgcctctaggactgaattgttgtataagtctgttcaggttgccataacaaaataccatataccaagtggcctaaactatagaaatgtgtttctcacacttctagaagttgggaagtccaagataaaggtgctagcaaagcggatttctttctaagatctcttcctacagcctgtaagtggctgtagtttcactgtgtgcccatgtgaccatttctttgtgcaccatggggaaggcggatgagcaagctttctagtgtctcttcttataatggcattaatctcagcataaggaccccactctcataacctcttttaaacctgattacctctcagaggccccagctgcataaaccatcacactgggggttagggcttcaacatttaagtgtgggagttggtgttcacaattcagtcaattggagtggaaattgaaatgggaaaggaaaactatagttactagagagagctattgtcttggagaggatcactggacaggactatagtctttggagaaataagtgagtgacaactgacaaagattctttctgtgaaaataagtaatttaaaatgtaagttgttggaattccaaattactttgagcctttaaaaaatctgagtatgggccaggcaccatggctcacacctgtaatcccagtactttgggaggcccaaggcaggcagatcacgtgagatcaggagtttgagaccagcctgactaacatggagaaagcccatccctactaaaaatacaaaattaaccgggtgtggtggcgcatgcctgtaatcccagctactcgggaggctgaggcaggagaatcacttgaacctgggaggcagaagttgcagtgagctgagatcgcaccattgcactccagcctgggcaacaagagtaaaactctgtctcaaaaaaaaaaaaaaaaagaaaaaagaaaatgtgggtatggagcctaagtcacatgagaggcacctgtaaactaggcagttttaacctttgtttctctgattatagattggccttcttccttacatacattttttttttttttttttgagatggagtcttgctctgtgggccaggctggagtgcagtggcatgatctcggctcactgcaaccttagcctcctgggttcatgccattctcttgcctcagcctcccgagtagctgggactataggcgcacaccaccatgcccaggtaattttttgtattttagtagagacggggtttcaccatgttagccaggatggtctccatctcctgacctcatgatccacctgcctcagcctcccaaagtgctgggattacaggcatgagccactgcacccagccacacgcattgttttctaacatgtcatataaattattgaagggtgccagggaagattgcttccctcttcactgctgactttcattatagattaacttccttcttaccttgctctcataaagacttcatggctattgcattgtcttaagatgcaatgttaaatacactcctttaaattggaaaggaaatgtgagccagctataaagaaagaaaacaagtagtatggaaagagaaaaaggttgggcacagtggggctcatgcctgtaatcccagcactttgggaggctgaggtgggtggatcacttgaggtcaggagtttgagaccagcctggttcacatggtaaaatcccatctctagtaaaaatacaaaaaattacctgggcatggtggtgggcacctgtaatcccagatattcaggaggctgagacaggagaatcacttgaaaccaagaggcagaggttgcagtgagccaagatcatgccattgcactccagccttagcaacagagtgagactccatctcagaacaacaacaacaacaaaaaaaaaaaacacaaaaaaacaaaaaattctgcaactaattaatttgttgtaactcttaaagcagccttatatagaaaatgttgtgatcctattaatttttttttctttctatgtaagcaagaacttcacttttgactttgcagcactgaccccatttctctggagtctgtgtgccctgattggctattcccagatttttgtttgaataaactcttttttaatttttaccattagttcccacaagcagaatgaataaacattttaacactgaattctgaacctttcatttatttcaggttgacatctccttggccaaactctaatcaggctcttctgagtcctcttctcactaggcctcaactattgagcttctgtgttcctctctgcattgttcaatctcagcaagaatccttctcagtcaatttagccagaattccccatcttcaatagctgatcactcataatatctaatagggctcctcatccttcaccatctgctaggtgatgtctgatcaccctgcgttcagcaagaatgctatatgttggcttagccatgtgggaagcccaaaatatgccaccccaaaatacactcctttggtataatttgagatggctatttagaggggctgcagatgttactgaggggtctcagcccaaaaagggactctttcctgtttattattgcaaagccaatgtatgaaaccaagagtgagtgtcaagcagtgcaggctctattcaatggcattggagaagtaggagcatagcatggaattggagaagtagtatagcttgcaaatcaccttctcggctactgagaaccaggaagttacaaatatagaggatctttaatgaagggaatgagcaaggtgaggaatattcatgcttttcttaggaagggatggagattttcctagaatcaaggagtcacctcatttctgtcctttcttggtctctttcgttcattgtcacagtgattgtcaactgtcatgcactgatgggagtgctatttagcatggaaattggattataataaagctagatgtttttcagaggttgcataagctgccatcatggatttcaccagcttcagctggtttagtcccaagaagaaacttctgaccacagacatcctgtttcttaaaaataagcagagttaaaggtgagtaagaattcagccatgacacatatgcactgcaatggccaacaacatctgggtaggggtccaggtaagtcatgtaggcagtgcaataggtaacacagtcacagaaatacctatgaaaagctgtccttttgtcagggagattagcatgtgtagaggaagtaaacatcaactgcaaatggctttctctgagaccttcttatctgctttatccggatccaggtaagattaactcacaggaaaaggaaacaaaagatctcatgcttttaaacgtctgacagagaaactttttttttttgaaacggggtcttactctgacacccaggctggagtgtgcagtggtgcaatcttggctcactgcaacctctgcctcccaggttcaagccattctcatgcctcagcctcccgagcagctgggattacaggtgcccaccaccacaccaggttaattaattaatttattatttatatatttatttatttatttatttatttatttatttatttattttagacagagtcttgttctttcacccaggctggagtgcagtggtgccatctcagctcactgcaagctctgcctcccaggttcatgccattctcctgcctcagcctccctagtagctgggactacaggtgcccgccaccacgcctggctaatttttttgtatttttagtagagacggggtttcactgtgttagccaggatggtctcgatctcttgacctcatgatccacctgcctttgcctcccaaagtgctgggattataggcatgagccaccgagcccggcctgtatttttagtagagatggggtttgccatgttggccaggctggtcttgaactcctgacctcaaataatctgcccacctcagcctcccaaagtgctgggattacaggcatgagccaccacatctggtggagggctacttcttgagagacttcatctgcatcacatctgcatcacaacacagcctttgctcaccatgtctttcctcccctcaacctcccataacctgtggccaccaccccctaagaactccaagcctagttagtcctttttgtgctgcacataaacttcaaccatacggccttctttgaggcttttttttttttttttgagacaaagttttgcttttgttgcccaggctggagtgcaatggcgtgatctcagctcaccgcaacctctgcctcccaggttcaagtgattctcctgcctcagccttccgagtagctgggattacaggcatgtgccaccacaactggttaattgtgtatttttagtagagatggggtttctccatgttggtcaggctggtctcgaactcctaacctcaggtgatcaggatccacccgctttggcctcccgaagtgctgggattacaggtgtgacccactgtgcccggcctgaggctcatatttttatgtgactctgtattagtcagggttctctagacagacagaattaataggatagatatacaaagtagtttattaagtattacacttactttttttgtctttttttttcttactttttgtggaaaacagggtcttgttatattgcccaggcaggtctccaactcctgggctcaagctatcctcccgcctctgcgtctctgagagctgggattacaggtgtgaaccaccacacctggccaggagtttattaagtattaacttacacaatcacaatgtcctgcaataggctgtctgcaagcttaaggagcaggaaagtcagttcaagtctcaaaactgaagaacttggagtctgatgttccagggcaggaagcatccagcacaggagaaagacgtaggctggcaggataggccagtctggccttttcatgattttctgcctgctttatattcatgggcagtggattatattgtgcccaccagatttagggtgggtctgctttccccagcccattgactcaaatgttaatctcctttggcaacaccctcacagatacgcccaggatcaatactttcatccttcaatccaatcaaatttgtgagaaacaaattcacctgtctaaacccaaacaatgaactcagagacccagagaacagcgaaagtgagacttttaatgacggtcttgcaagatcgggtgtctggcatgcaggcacacccagcacagtttcaacaagcaatttacgccctagtgcacaggtccctccctcagttcctcataggctgagtactagccttccacaatcttcctagacatcacctattgattgttcttcaagtacattctttagggtctttctgctgcattttattgcagcacacgatgcattatgactctcaggatttttcaaacatttgacttacggctctagtggctgcacttagctgataagaaagggtacaattatctatgttgcaagctagcttaaactaaatttctttgtggagcggggaaggggtagatgagggggcccccaccgatagatgcctggccactgggtgaaagggaaagaaggaaggtggagggggtggctcagtacattctgcttctttatttctttctttccaggtagcctgcctaaacctataccaagccacttagaattgaaaatagataatcacatataggttatttcctactattccctcctttttctttttaccctttttggtgtcattttcacttaaattgctttttcaaactgttccagaattgtttacttttttttttcagatggagttttgctctgttgcccaggctgcagtgcagtggggtgatctcggctcactgcaacctctgccccccaggttcaagcgattctcctgcctcagcctcccgagtagctgagattataggcgcgctgtaatttttgtatttttaatagagacagggtttcaccatgttggccaggctggtcttgaactcctaaactcaggtgatcatgagcacctgcttcagcctcccaaagtgctgggattacaggcgtgagccaccgcgccaagccagaagttgtttactttctttctcataggaggaggagtttatttggtttctaataatagtaggttattttgttggaacatcaggggcatctgtttactgagagttgttttaataaaccttagtgttatatatatatatatacatatatatataaaatatattacatctattatatatagtagtagtgttaaaccccttacacaagtattgatgcaacatcgtatgtcaatgacagaatctgttaagttggaagagtatactgtagaaggtacatacttcactttttttttttttttttttttgagatggagtcttgctctgttgcccagtctggagtgcagtggcgcaatctcagctcactgcaaccaccgcctcctgtgttcaagcaattctgctgcctcagcctcccaaatagctgggattacaggtgcccaccaccacatctggctaatttttgtatttttagtagagacagggtttcactatgttggccagactgatcttgaactcctaacctcaggtgatctgcccgccttggcctcccaaagtgctgggattataggcataagccaccaccctggctcatagttcactattgaaacaaacttttttttgtgtacagaagaaaaaaaatcgtacagttaacagtgtcagagatagtgaaaatatgaaacaagaactgcttacaagaaaggagcactcaggggaccaaacctctgccagagccagcggggaagtgacttatgcctctctcttctttccctcctgtccccgcccctcgtctcccgcaatgaagcgggtacttaatctgtgtcctgtggaggtcccctttggcagccagctggaagcccgtgcacccttcttcaaataatggctttcaatgagcagactaggacgtttaggattgcaaaggaaaccgattcctttcaaacctgattatctttgtgatgtggcactgtttgcatatcttccttaaaatgcattaaaggccactgcactccaccctgggtgacaagaggtgactgtgtctcaaaaaaaccaaaaacactcccccctcaccccaaagcattagacgtcaaggctggcagggatgtctgttctcttgaaagttcaatatcaattcaatactttaaattcactgtagtttcaatccattggtatggaaagtgttttgaattattgtactgatttttttctatcctctttctgatacgcatgctaatcgtatggaccttggacatctaccttcctgaacttttctctcctgtttttacattattattttggtttgtgggaaatattcttgacattatcttcaacttaatttttgttcttgcttctactattttagtttaatttccaagtattttgatattgaactttcaagagaacagacatccctgccagccttgacgtctaatgctttggggtgaggggggagtgtttttggtttttttgagacacagtcacctcttgtcgcccagggtggagtgcagtggccttcaatgcgttttaacgaagatatgcacacagtgccacatcataaagataaccaggtttgaaaggaatcggtttcctttgtaatcctaaacgtcctagtctgctcattgaaagccattatttgaagaagggtgcacgggcttccagctggctgccaagtgggacctccacaggacacagattaagtacccgcttcattgcggcagacgaggggcggggacaggagggaaagaagggacaggcataagtcacttcccccgccggctccgacagcgggtaggtccgctgaggggcgttgggtgaggcggaagagcagacggggatccggaaggcgttgtcggtgacatcacggagagggcgatttctatgtagatgaggcagcgcaggggctgctgctttgccacgaaagagttcccgtgccgtgggagcaagtctgggaccgctggtcggaccggagagtcgcagctgtgtgttagggctaggatggctccgggatgcgcgtgacgcaagtgaccttgcgtgtaaagggtgaggaatatgaggctgcggcggggcggaggggtgtgagcttatacttatatttatctggcagaagaaatgttatgatcacgaaggtggtttttccagggcaaggcttagcaattttactctggatgtgctgacccctgtgatttccccaaatgagggaatctcgactacataatttgtggcagtggggaactgtttgtgctttcccctggattgctgtcgttttaaaagtggattttgtttgctgtggaagcatatacaacgcgttagtataaactaataaacaggtctttgttcccatctgtcacttactttcaaagtaaagattttgtcaggtagtggttggttctcacgcttgtaatctcagtagtctgtgagatgcattgataactttatgttaataccgctcgagctctggagtttgatgtcagtgtggtcaaatatggtggacccgtctctactaatctcttaacttttttttttgttctatagaaataaaactaagcttttcttttccctatgggagcccactgtaaacatttattaacagcaaacagttcactggagtgcatggcttactgcaacctctgcctcctgccttcaagctattctcctgcctcagccagagaatactcgatctcctaggtaactgagattacaagcgcaggccactaaaaaattaggcccggctaattttttgaatttttggtagagacagggttttaccatgttggccaggctggtcttaaactcctgacctcaagttatccgcccgcctcggccacccaaaatgttgggattacaggcctgagccaccgcgcctggcctgtttacagactttacagacagattttgtttacaagctttacacgcacggttcagttgcagttagtgtatattatgctgggcccaagacaagtgtcttttttttttttcccagtgtggcccaaggaagccaaaatttagacaaccctgctctagagggtttgattcatgtttccactgggttatgcttattgcctgtaattccatttgatattttccaaatttgattttttaaaaagcgttttcctgaagcaccctaaagctttcctaataatatgggaacttaaaccagattggatgtgacaaaaccctgctggaatcctgcaacttctaaccttaatgttagatcaagaagcaaaacacccaccagtccaagggtcagggaagatgaagatcatgcctgagctgtaacaacgcccttcccagtatacaaaagcgtgtaacagccactcgaattctatcttccaagtgtctcctgttgcccaggctaacctagagctatctaaagatggcaaatctgggaaatgtgcattcagcttggcaaaactgatacattacaaatccaccacagtccacttcttctcaaagtggcatcaatgtgcaccttcctcctcctccttttttcttcctcttcctcatcctcttctttctcttcttcctcctttttcctccttgtaaagccatacttaaggttcagataaagacaataggaaaatcatactttttctcattcagtgaaaatatgccaaccctttccccaacaggataaagtcttttatttgtctttgaatgatgttcactccttttttagctagatcacattccatatttgctatcctgtaacctaaatattgagatttctaaaagttaattattaatgaatatgatagcgaggatgatggaagacgagaattctcaagaaaagtattggttaacatataaccaaatgtattcatctcaaaataatgaagaaatactcctaactattacaagtcctcatttctgcaactgtcactggccctagctggtatttgtaactatctttacatcttgctctcacagccatttcctttgggcctgggccggtggacgtgagcgtgggaaagaccagaacccgcggtgccccccaccgcactatcctcgggtctccagaggtgggatccactgggcaggggcctttgctggattctaaaccggctctggggatacaagaacagctgcctttgagaaacagttcaggtctctatattccagacttcttagtaggactaaacccttaattttcacccgggaattcatggttctcctaaaaccctgcggtggaatgccttccttcaccgagcatttattgggcacctactaggtgctagggtggctctgggcgaagggctgcagcctgtgcaaactccaggtccctttcctgtggatcccacctctgaggacccgagggggacgcagtgaggacaccacgggttctggtccttcccacgcgcgcgtctgctggcccaggcctggcagaaatgactgtgagtgcaaggtgtgagcggggctaagaatgggaaagagagtgactttcgcctgagaagctgcagttgtcgcctgtagaggggccggcgacttttgagacggtgaagagcaggcggaggaagcagtgaagagcagacggtgaggagcaggtggacctttggccgttggagtcccccagctgactctgccagagtagaacgtccaaagtgcccaaagactcgactcttggcttcattgtctcccgtattatgggtttctggagtgcgcgggattggacaggcatcaaatacatgagattatctgcagccagaggttaaaaagccatttctggtatcagcaaatgagtttaagacacaagccattggagtctctgtggcgcaatcggttagcgcgtttgactgttaactgaaaggttggtggtgcaagcccatccagggatggcaccttttgcttaggcaagattcacactttctgtttaaagactttaatcctgggaatcctccggacctctattagctttgaatcagatgccaaaatatgctgcgtgaaggctcaagttccatggaagttcctaaaaacaggaatatttcagcaaaagtaatttttcaatagagcctgagcctggggcttcagagcttacaccagagccactgcacctatttcatcacctcctgaagctgggtttttacaattgcacattcctggaaatccaaaactcccaataattgaaaacaagaaaaccccagtcttcacttgtggtgaagcctcaatttctgggttgaaatcttggttcattcatgacgtgacttttaaaaccttactggattttctgtacctcaatttcttcgtctataaaaaagagcagccaggcgcggtggctcacgcctgtaatcccagcactttgagaggcccaggcaggtggatcacctgaggtcaggagttcgagaccagcctggccagggtggtgaaactccgtctttaataaaaatataaaaattagtcaggcatggtggcgggcgcctgtactcccagctacttgggaagctgaggctggcaggcacctgtaatcccagctactcgggaagctgaggcaggagaatcacttgaacccgggaggcagaggttgcagtgagccgagatcatgccattgcactccagcctgggcaaaagagcgagactccttctcaaaaaataaaaataaataaaaaagaaaaaagaaagaaagaaatttttcctggcacatttctatatgttccattctggatgacttgctcttcaggcttatctcacagctgttatcataatatctctctttactgcaccatcttgggatttccatgacctctctcttgttagatcccctgcttcatggatctcaagggggtgcattcctcactcacttcttccttttgatgatgcatatccttcaagacctcctataaagtggttaccttagaaataaactttttgagacactgcatgtctgaaaatgtcttttatacccataaagttaattgatattttactagatagagatacaaaaagataggtggaaataatttctctctgagatttttgaaggcactgctttttttttttttgtgacagtctcgcctcgctctgtcacccaggctggagtgtggtggtgggatcttggctcactgcaatctccacctcccaggttcaagcgattctcctgcctcagcctccccagtagctgggactacaggtgcctgccaccatgcccggctaatttttttatttttagtagagatggggtttcaccatgttggccaagctggttttgagagcgaccactcctcatattgtcttacacttaatttcttgtttgctgaaaaagtggaggttgaaagaatgggcagaagtgaaaatcacgctcagacaactgggtgccacatttcaggcctggttgttaaaattcaactgctgacctcaccaattgtgctgtctgtaaattccagacattgtataaaaaagcattatgaaattcccttttctgtcctgtttcattctgattaccagtacatgcagcccccagtcacgtacccctcgcttgctcagttgatcatgaccccccccccatgcagcccctttagagttgtgggcccttaaaagggacaagaattacttgtttggggagctcggtttctaggatgtgagtctaccgatgctcccagctgaaaaaagctcttaccttccacaatccggtgtctgagggattttgtctatgactcctgctacagtttcaaactcctgacctcaagtgatccgcctcccttggctttgcaaagtgctgggattacaggcctgagccacaacaagagctcccggcccttgttgtttactgctttccatagtcatttctgagaaagagaaaggtaagccttttctgctctgagctagagctggtctgacaaacacctaggccatggtgttgtatggttaaaactaaaaatttcacaacaccaatatcagacaaagttaccccctcactaaactgaaagaaatactatttcacaatcatatttgagcataaaaagaacactgttcaaaccataatatgatcaaacatcccagctactaatagtgacggttaattattttattttttatttttttgtgatggagtcttgctctgtcaccaggctggagtgcagtggcacaatctcagctcactgcaacctctgcctcctgggttcaagtgattctcctgcctcaaccttccgagtagctgagactacaggcacctgccaccacacccagctaatttttgtacttttagtagagactgggtttcaccatattggccaggctggtctggaactcctgaccttgtgatccgcccccgccccgctcagcttcccaaagtgttgggattataggcatgagccactgcaccaggccatttttttttttttttttttttgagacagtctctgttgcccaggctggagtgcagggccgtcatctcagctcactgcaacctccacctcctgcgttcaagtgattctcctccctcagcctctcaagtagctgggattacaggcatgcccaaccatgcttggctaacttttgtgttgactgttgattctttaccaattatgtgtttagtcttgcaaccatttctctcactttctagataaaaatatcgagattcccaaaggaagaattgtcccacaatttccccatagtgtttgctgtctcctctgttgcaatgagccaatatactcaggtttgactataggtttgttcctgatggttacacactggagcacatcagcaccatagagaagatggatgccgttctgattctttgttatttgccttaaacttttctcccatctcccctcccaaaagcctatagaatcttctacctcttcctattagtttgaaacttcatgatctatttccatccaccatgctgggtactcagtgtgctctttcaatatgggaatttgtattttggaggtatcattccaaagatgtttatgcatatacaattaaaggtatatatttatttcctgcaactaccatcacccttttgatacacttctgctgtataataaaccatcccaagcttattgacttagaatagcaataattggctgggcgcggtggctcacacctgtaatcccagcactttgggaggccaaggcgggcaggtcatgaggtcaggagatcgagacgatcctggctaacacggtgaaaccccgtctctactaaaaatacaaaaattagccaggcgtggtgccgggcgcctgtagtcccagctactagggaggctgaggcaggagaatggcatgaacccgggaggctgaggttgcagtgagccgagatcatgccactgcactccagcctgggctacagactgagatctcgtctcttaaaaaataaaaaaagaataacaataatttattatttttagtgattctgtgagttggcttggaaattcttctagtccaagctgattcatttggggctggatggtctaggatggcctcacacatctggggtataggtggattggttggaaaaagtgggatgcatggatctttttcttcatgtgatctctctagcaggctagctttgggggatcttcagatcatggcctcaggatttcaagtgaagaaaaaagcaggtaatcctcccatgtgcaagcctctcttctgccaggtttgcgaaggcaccaacatttgcccaaagcaagtcatatggccaattcaagattcaaagagaggagaaatagactctcttgatgagagaagctgcaaaatataaccactttttttttcaatctatcacagtataccatactggactatcagtagcttcctcatttttctttctttctttctttctttttttctttctgagatggagtctcgctctgtcgcccaggctggagtgcaatggcgacatctcggctcactgcaagctctgcctcccgggtttagccattgtcctgcctcagcctccctagtagctgggactacaggcacccgccaccacagccggctaattttttgtatttttagtagagacggggtttcaccatgttagccaggatggtctccatctcctgacctcatgatttgcctgcctcggcctcccaaagtgctgggattacaggcgtgagccaccgtgcccaatgaaaacctttattttcgtgatggctgcttatttatttatttatttatttatttatttatttatttatttttctttccctgctctccctctttttaaatttttattatttatttatttattttttctgcagagatttatccaattcagaggtcttgtccccataatttggaactttcctttggatttgatcaagtcagatagaactggtcaaacccaatggggaaaagaaggaaacaacaataaaaacacaaacagaaaacaaaaaacagttcagaaaattagtgatcgcacaatttatatgattgcctagcactctaacggtaagaagaaattataatcagttggttgttaatcttttttatttttttattttttatttttttttgagacagagtctcgctctgttgcccaggctggagtgcagtggcgcgatctcggctcacagcaaactccacctcccgggttcacgccattctcttgcctcagcctggttgttaatcataactttaatcatttaggagaatttccaagacaaaacacaggttcagttacttacctaggaatggggcccaggctgaagactgctctgtaccatcttagaagcaggaaaaaactcaaactctccttccctccttccctgttagaagtgaactgaaaccccagaaaggaattgcctgctctccatcatcatggaagcaggaaaagttgccttcattgttggaagcaagtaaaactccagaaaatgagttgtacagcaaaataaagcttagatctcaatcaaattttgggaaatcagggattctctggagggggtggatctctgaggcctcagcaaattgtcctattggtttgagcaataaaaatagctcaagctggtaccaagtacagataggagatttgtcaaaggtcagggcacctccactcagaattccttcatggttatcaattgtaaaccaaaaagtatgtgagacaggtctgaattgatttagaaagcttattttggactcttactcataggtaattctagtcttcatagaggtatagcagccaggtgcaaattgtgggggcctggaaataattttggtataacagagattaaataatttgtctaagcaatagcttggcaactttgggagccaagttgtaatcctggaaagattaatgcttggcctgagatgtaatagccactcctccaggttgtcttttaatgtgggaagtaagttctagtgtgtttctgtagtgtggaacttttagaaataatattcttgtcacatttgacaatacccatggctgatctagacaaaatatcatccagtcgctgtttagccctgatttgcatatgagactttgtgctggtcatctggtaacttttcactcggcagtggggatgaagtaactgaaactccagaaagaagagttattagatacctcaaaaatgatgaagatattagaagccctggccttaggggtccaaggaagagcaaggtttgtgggtaataatctgtataaatctgataggaagctataaggaggactcttaggactatgaggtgggtgatgattagagcctggattaatcaagggcctgtggcttctaacaccatcagttgcctgtactcagccaccttcagcagtgctatctggctctagagagccatagcattccaggaaaggagagaaggctgcacaaagccctgatgtttgtgtccccccatctagacagacataatagcatgcagggacaaagcaaaagagaagagtaggcagagacaatgtgaatctgttcaccacatattgtaaatgcatttaaaaatattgttagcccatatttgcaggtagcactaattatgaagttgttggactgaggactttatttatttgtgactctcaccatcttcaaagtcagcaatgaagagtttcttcctcattgaatcactaacgcgttttggatctctctgacttcctagtttgctgacctctgacctctagatccagactttaaaggcccatgttattagattagtcaacctttataatctccccattttaaggttaattgtatctgcaaaatccctttgccattcaatgtaatataattatgtaattagcaaccataagaaagctgaagtgacttttaaaccaacccaattgtcccatagaactgatgtttacggtttcttttgaataaacatagaaattgaccctttcagtcttgaaatttgagaaagttacatttgcattatctgagttcctttctcaggaaaccaagcgttgggccctccagatagtatcaaagaactgaaatttaccagagtaccacatctggacaatgaaatatcagaccccttatcccatcaaaattgcctaagtgaccacctgcttcctgttgaccaattcctctttcttacctctccctaattcctgttttcctgcatgtagttccatttcttccctgctatctaaaccctgaattttcattggtcaggaagatggatttgagactgatctcccatctcctaagttgtagtacctgatgaaagccttctttcctagcaatgctagttggctcagtgattggctttctgtgcagtgaacagcaagacttaaatcaaacctctggtgtttcagtagcaactatcctaataccagacaaaataaacaagagactttaagacaaaaaaagttactgaagacaatgagggctattttgtaatgataaaagggttaatccatcaggaagagattacaattataaatacacatgcatctaatagagcctcaaaacacaggaagcaaaaactgacagaattgaagggagaaatagacaatttaacaatagtagatggagactttaataccacaactttcaataatggatacagcaactacacagaagatcaataaagaaataaaagatttaaacaacataacctaccagacatctatagaatactccactcaacaaaaacagaatacacttcctctcaagtacacacgggatgttctatagaatagaccatatgttagcttttaaaataaatcttaataaatttaaaaggactaaaatcatataacttctgatatatctcataaactaatactatcacacactatagtttcaggttagcatgtagggtatgcagtttgttggtcctgcttccttctgtttgtcatgaatgtggaggtgaccatgattacacatgtgtaggccagtagcccaggaaagtcaggcagctgaagggaaaggacagatattccataagagtctccctatctcagtctcaaaaaaccagggaggaattgatacataggaagtgaagagttacatcaggggatgacttctcttctgcctatctatgcctgtctttaaaacctcagtttctatcccactaaaccccattgcacaggaaaactgttgatcaccgccaaccaccagactcattaacttgatttttaccatgctttgtctgagaatatatcctcaggccaatgcaaatcattagtgttccataaaaactgcttcaaacacataaaatagtaacagtttataagtcattccaaattaggtggcaactacatgtatttaaagagatatacataaattatttcagcaattgtgacaaattggaaagaaagcatgtggagttagaatgaaaatcataagtgacaagcacaaaatatgtatacagagattataacactaagcaaaccacacatagaagaggagagtggggttaggagttatgaatatcaagcttgtcctcaagttaagtgaaaagccagcatgggccaggtgtggtggcttatgcctgtaattccaatactttgggaggccaaagtgtgagaataacttgggcccaggagtttgagacccacctgggcaacatagtgagaccccatctacacaaacacacacacacaaaaacacacacacacgcacacaatagctgagtgtgatgacatgtgcctacagtcccagctattcaggaggctgaggcaggaggatcacttaagcctcggagtttgaggctgcagtgagctgtgatcatgccattgcactccaggttgagcagcagagctagaccctttctattaaaaaaaagcaaaaaaacaaaaaactaacatgcttccccagtgggggaaaagatgtcagtataacattggtttgcagcaagaagtatattaagatattgatcaaaatccttttattatttattttgtttttattttttgagacagggtctcactttgtcatccagaatggagtgccgtggcatgatcttggttcactacagcaaaacacacctggacccaagcttgcagtgagcaatcatgtctcactgcaagctccacctcctgggttcacaccattatcctgcctcagcctcccaagtagctgagactacaggcacctgccaccacacctggctaattttttgtatttttagtagagacgaggtttcaccgtgttagccaggatggtctcgatctcctgatctcatgatctgcctgcctcagcctcccaaagtgctggaattacaggcatgagccaccgtgcctagccctatgcctggctaattttttaaatttttttgtagaggcagggtttcgtcgtgctgcccaggttggtctcaaactcctgagctcaagtgatccaacaaccctggtctcccaaagtggtgggattacatgtgtgaaccactgcacctggcctctaaatcgatataaatcaattattcacacactgagaggaatattcaggatttttttcttataatataaatgatgtgaaaatctggagaaccaaagaagaatgccaagactatctaaaagtgttaaatttttcattaggaagaaaatgacttcatgatagtaattaagacagtgatagaacttggggaaatatgtattccttgatgttttctatgcatttgcaataataaacaatgaaaatatggttgaattttagaaagagataggcctgtggtattgtcacaagggtatacaaatactgagattgacttgttgaggcagtggtctccattggtggtgaccttcagaagagacctgtgtttccacatggcctagacacctggaaggcagagatcctaacattccatgacacccccaccttctaattctgattgtgactccagaccattacctggcactgggtcttacctctggcattcctatcagagcctgaaccacagacagtaccttagagtctaagcttaggtacctttgtcttgtttttgtggctaaggattctcagagttgcgggatgctgatgaaatttatcccaaaagtaagttatgaatcagatctgctttcttttgactcatttaaatcctttgtttaatgtaaagaaactttattgaggtataatttacaaactataaaatttacccattataattgtacagttgaataatttttagtaatttacccaagtagtgcaaccattaccataatccatgcatttgtttttaatttattatttgtctgggttctgattctacttcctcaacaagctacagcatggcagtatctgccaccacttgttttggtccaagggcagaaatcagtatcctggaaaccaatcagtacttgcgctctgaactggaaaagtgcaaacagaacttccaagacctcacagagaaattcctgacatccaaagctactgcctactccctgaccaatcacctgcagaaatatagtaggtcccaaaggggcatggtcaccaaagtgataaatgattgcccatctttcctctgtgaaatgaaacactgcggactttattctctatcaaaattaattttatgctaactacactcccagaaaggtagaagtgggccttttactctcaatttgccaaggacagaaaaactgaggcacaaaggtgtaaagtttgcagggcgagtgtagtgaggaatagagactaaaaccttggtttaggcctgaaactgtctttcccctctcagcaatgaatatcagattctacaaacatgtaacatcactgttggttaaaacatctcaggattcgatttaaacttttttaagagcgcccatttgcaaagcactgtgccaacagcatcagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcagataagccattcctcatgctctggttagattgagggtatttccagaaaaatcagagactttgtaacaccctttctgtctctctctgagtatcaactttacagacagcaagcaactgcaggtggacatccaggatcagagctatgagacatatggccaaaatgagaacaaggccaagtggaacagactgccattctcaatagaaggccaggccaggttaggggctggccccttcctctccacagttagctctcacatttttaaatccactgtaaaatcccaaacatgttactaatagtcagggaagggaagctgtaatgacaaggaaacgtgggaacaagggcatgagaggaacagggatattagaagaggattctggttaacatagaaattgagtttgttttccaatttctacaattattttaaaatacatcattgtgtgggggtggctaaaagttgctgtctaacttactgtcatagaaaagtaaagccaaaagcccacttattaaagaagtgaaaagatgagctttggtgtgtggaaaaactagtttaaaaaaaaaacccttcactcattataattgtaggaaaaaaatttctcaagctagagaagaagaaagatattacctaagaccctaatataaaggtattattgtgcagtgattaaagagcatataccctagggccaaatttcctgggttcaaatctaacttatcatcactgtccctcagttttctcatctgtaatggtaatagagtaggaactacctctttggatggtggtgacgatcatatgatgataattcttaaaaacctactgcaacagtaccgtgacaaacactatgtgttggttttccctttaaaacaccacctactagcttttgggcatatatcatttggatctttctcctctatatacagttttacacagctgtatacagataaatgtttaaatctttgaaatattttgggattattgaaactcctgacacaggagggccatcagtcctaccattcttagtatcttcccaaacacacaggaagtcattatttcatgcccttatgttcatgttttacttaagaggctgtaaggcttggtaaattggccttaagatttgaagtcatggctgggtgcattggctcacttactgcaatcccagtactttgggaagccaaggtgggtggatcatttgcagtcaggagtttgagagcagcctggccaacatggtgaagccctgtctctactgaaaatacaaaaactagcagggtgtggtggggcacacttgtaatctcagctacttgggaggctgaggcaggagaacaacctgggaatcagaggtgcagtgagccgagattgtgccactgccctccagcctgggcaaaaaagtgagattccatctcaaaaaaaaaaaaaaaaaaaaagaaaagaaaagaaaaagatgtggcgtcagatctcaggggatgtgaattctgactgcctcattccagttgaatcatcttgtcaagtgattttatcaacctgtgggcttttctttcctcatctctaaaacagggagtagttgagagactgaggaataaagatatggaaatcccagtgtaaagcctcgtactggggatacttttatccttgagatagaccctgcctcctgctctgcaagcagtgaccacagcaacatggccagccttccatgatgcaggcatgtctgtcttttctcagagtgtgaagagtgcaaagaccttatagaatctgtgctggaggaggaggtgcagtttcaggagagggagctggccgaattgccgaggtcagctgcaaggctccggtaaggaggtacctctgtgggaagtgcataaatactgtttgaagcagggcagctcaggctggtagaacaaagagcaaatttgtgcaaggagaagggcagaaatgtatgactcaggcacagaactagactaagacacaatgaggctatggtctagttaggtctctagggttttccattaaatagcatattagtaaaatggagacagctgcctgcattggaatactagcaatgtggcttctatttgtgtgtccttggtcaaatttacttcacttttctgcgtgtcattaacctaggctacctcatttataaaatgcaaatactgacagtatctactcagagggttatgaagattaaatgcacaattgcaagtagttagaaccatctctagcacatataaaactctgaacaactattttctgtaattattatatttgttcccatttatagatgtggtgattgtcattaatattttctataagagatattttcaaactttccaaagtgcctttcatgataacaatgtttctcctccaaactttttaaaaaagtattatactaggtggagtattaactggtagggctattgggtagatagatgattgagcagctgttgtgtggaaaatgaattattaattcgctcaggaccagcattgactatccttagagggtttcagacataaggtagattgtagcattcgaaacttcttttaatcctttgttgaaatgaaatcatagaagctcaaatttctaaaactcaccaaagcagagatatttgattgaaggtgggataggtctggagcccctatttctccccagtatgtctttacttcccctgacactttctagtaactctaagaaatagagtttgaaagaggacctgcagataactacttagaagactggtggggagaaaattcaagcattagatgggttagatgactgtaaatgttcagtctagctctgggattacatggttctaaacattaactgaataactacttgtatgtgtacatactaccgggtgctgtaagttgggtaataggtagcactatctttagactcacagagctcacactctacattggaacccatgtgtattagtctactctgacactgctataaacatatatctgagattggtgatttataaagaaaagaggtttaatcggctcatggttctgtgggctgtacaggcttctgcttctgggcaggcctcagaaaacttacaatcattgcagaagtcaaaggggaaggaggcatggtcttcacatggccagagcaggagagagagagagagcaaagagggaggtgctacactttcaaacgaccagacctcatgagaactcactcactatcatgagaacagcaagggggaaatccaccaccatggtccagtcactatccagcaggtccctggttggattacaatccaacatgagatttgagtggggacacagagccaaaccatatcaccatgagaaatatttaaacaataattagaaaaaaaataaatccccacagagtaatgaaattactactcagaactttactttttttctttttttgagatggagtcttaccctgttgcccaggctagagtgcagtggtgtgatctcagctcactgcaacctccacctcccaggttcaagtgatcctcctaggtcagcctccccagcagttgagagtataggtgcacaccaccacaccagctaatttttgtatttttagtagagatggggtttcgccatgttggccaggctggtctcaaaactcctgacctaaggtgatctgcctgccttggcctcccaaagtgctgagattacaggcgtgagccactgtgcccggccagaactttagttttaactgccttcttactgattatagtctatcttcatgtcattcagaagaacactgcccctcttgaccttttcactgatttttctttttaactttcaattaatactagggataccggcccaacagttttgaacttggcttttttttttttttttttttttctgccagttactgcatatgaaaagatacttgggctaaagtggggaaccaaaggggcatctttttaaaggaaatttagtaaaataacagacaaacccaaggctgcctcttcattccttctgccacaggcaagtcacacaacttgtacaagaattcatcttgggccaggtgcagtggctcatgcctgtaatcccagcagtttgggacaccgaggtgcatgaatcatttcaggtcaggagttcaagactagcctggccaacatagcaaaaccccatctctacaaaaaatatataaattatcctggcatggtggtgggcatctgtagtcccagctacttggaaggctgaggcaagagaattgcttgaacctgggaggcggaggcagaggtggaggttgcagtgaaccaagatcacatcactgcactccagcttgggcaacagagtgagaccctgtctcaaaaaaaaaagaaaaaaagaattcaacttgggagttccttacagggattctaagagatctctcctctgaaacttctataacctgttattcactacattccctcatacattttactcttctttcccaccttaggatacatgatcccttaattcaggctcaggctgaagaactgacccacttacgacagaagacacaggaagggagaggtgtctgctacctttttacccagcatgtgaagaacacagtcaagtcttttgagggccttctcaggaacactgacattgcctactaccagagacagagattctgtgagcaaatggtacaaggaagccagctgacagagatccttgtcagaaaacttgccacaggtaagttggctacaggctctgaagacccttagctcctcccaagtgtcccaaagtggggagaaaaaatgcaaacttatctccattgtagattttattttagttttgactatggtccttaatctgcattctattgttttctctttagagcactcaggtaatcacttttcatattctttcaagaattctaagttttgttttttattttgagacagaatcttgctctcttacccaagctggagtgcagtgacacggtcttggctgactgcaatctgtgcctcctgggctcaagcaatcttcccacctcagcctcccaagtagctgggactacaggtgtgtgccaccacacctggctaatgtttgtattttttgtagagatagggtttctccatgttgtccaggcttgtcttgaactactgagctgaagtaatccacctgctttggactcccaaagtgctgggattacagatatgagccactgtgcctggcctgagagttcttagtttcaatcagtaagagaggtagagtatagtggattacttcatcttgatgagcataagaactcaccttcatttctggaagatgttttcactggatgtaggattctagttgacagtttttgttttaaaaaagtgtttgaaaagtgatattccgctgtcttctggcttacactgttccaacaagaagtctgccataattcttatttctgtttctctgtacataatatgtcttttttctctggatgcttttgagattttctatttatcactggtttgaagcagtttgattaagataagaccttgtatagttttctcttttacatattgttctactttatttagtttcttgcatctgcatgtttatagttctcatcaaatttgaataataatgacatatatagtcttacctatggcatatacaatatattatatttcgcatatatacggcaaatatatataatgtatattctattctttctctctatcttctcctttaaagactccagttatatttgtattagctgctttgaaattttaccacagctgactaatggtctgttcatttttgttgtatcttttctttctctccgtttctttctatttccatgtcttggaattgattaatctttcttcagcagcatctaatctgctgttaatcctatccagtgtattttcatctcagactttatttttcatctaaatttaatttatgtcttttttttaaggtcttctatgtaactcttcatcatttcatattttcctctagcttctttattttattttattctattttttgagacagagtctcgctctgttgcccaggctgaagtgcagtggtgagattttggctcactgcaaccttcacctcctgagttcaagtgattcctgtgcctcagcctcctgagtagctggaattacaggcacatgcctccacacccagctaattttcatatttttcagagagacggggtttcaccacattggccaggccgatctcaaactcctgacctcatgtgacccacattggcctggcaaagtgctgggattacaagcatgagccaccacactggcctagcttctttaatacaaggtatacagttatatttgtttcaatgtgcttatctacagattctctcatctgtgtcctttttattgttttttaattctcacctgatgtgtcttttctaagtcagtttaagtagattgatttttttcccccttcttatcatggattacagttttctgtttctctgcattcctaacattattttatttggggttagacattgagcattgtaacttattgggtgctggatttttttgcattttgtgttaaaattctttgagctttgttttggtatacaataaagttacttaaaaacaattttcatctttccaagctggctttttaattttttttaggcaggataagagcagctattagtcaactgctattttctttcccactatggaggcaaaatgacctttaagaaaatagaccttattttttagagtagtttcagattcacagcaaaattgagcaggaagtacagaaagttcccatataacccctgcctccacacatgcatagcctcctagactatcaacatctctctccagaatggcacatttgttacagttgatgaacttacattgacatgtcattatcacacaaagtccatagtttacattgggggcaatactcttttgaagattctaagccagtgatctcccacagatttggcaccagggactggttgcatgaaagacaatttttccacagacaaggtgggggtggggtggtaggggttgggaattgggtggtttcagtatgaaactgttccacctcagatcatcaggcactagttagagtctcataaggagcatgcaacctagatccctggcatgtacagttcacaatagggtttgtgctccaatgctaatctaatgccatcgttgatctgacaggaggctgagctcaggcggtaatgctttctcgctggctgctcacctcctgctgtgcggtcccattcctaacaggccatggaccagtgctgggggtttgggactcctgttctaaccaatgctccctctattaaaagggattttcacactagctgatggaaacaccaagtgttgcaagctctgtgtgagctacagagattattccttttgggaagttctttgccctgctttgcataatttcctcaaatacatgtactaataagtacttagctgaagattgaacacagatatccaaggcattctctctgtgcagcaacctattctctagtctgtcctgtgatgtctagccaccctgacttcttcaaacttactaccaggctctgcctgggtcctccttccctgctctgcagttgacaaactcaggcagcaaactggagcactcatagggctcatctcttctattttctctctctcagggatcaatgtactgtactgcactatatccaatgttgaagctagagtttaaaatactttttccagtttcttagttgtttaaggtggaggacaaatctagtccctattactccaacttggccagaagcagaagtctccattccatctttgtggtcagaaagaacagtatgacagaaggcagcttgttagaatagaaagatccatggactaagaatcagaattacctaggctctagtctcagcactgtatttactaactttgtgcaagtgattgatccctcctgaatttctgtttcctcatttgtaaagtgagtcaaatcataattccacggctgctgtacagatcagttgaagtagtatcttaatgttcatgagtgtatttctctttcagggttatttatttatttatttattttcaggtcccaatagactgtccaaatcttttggggttagttcaggctctgtatatagtagaagctggtgttagaaaagttgatttataccggaatatttttcatagaatcacccccaattctcaccaacaaactgagaagaaaaaaaaaagaattacccccaagaacatctgaggaagcacaacagggacagacttgaaggtacctgggcagtcctctggttttggagtagaggtaggacagggctatttgtcctctcagagactggagcaggttctgtgtgtgagtagctatgggacaaacagtcatggtctggcaaacagcctgtggcaggaaggaaggttacaactggagaagtccaaagggcagccaggcaagtattctttgagctggggaacaaaagacattttaaactttttgctctgcttcaggcagctgatgtcatggtgatgattcaccacatcaggaacaccctgtccagtgggctcaggcaagcctgccaggccacttctctaaagacaccacctgaggcctcctgcaataaatctcacagagtattctgaacacacatgtaaagtgttatgtccctgatcatataggccccatgtgtgcaatgtgtgaaatgggacttgcctaatttctgactagctctttctaattttggtttgcagaaaatcacaacggtaagaaaaatgaagacaggcaaaagccactggctcctaggtaactctatatgatgaaggggctgataatggactgaccaaatctagagaggattccagaagcaaggactcaagaggttaaaggtcccagatatagaaaaagcagaaactgctgattgttcctttttttgttgactgattatacaatgtgtccttttaaaaatggttctctgttctctttgcagttcttgtattggttcctagttcctactaatttctcacacttagttaactagtcagtcttactgaaaagtaaactaaccagggatccctggtttctgtatctttcaaacctatagggttacaaaccaaagtgagatgcctatctggtttctgcacagttgtcctgaattatgttggcagatattttatacctagaaattcaccttgaaaaataaattgaaaccataccaagtatttagagctaggggtctaaagtctgcaaaagccctgggaggttgcgttgtctcaagagccagtattcaatggaccactccacatcatagtaaataaaatttgaacacagcattttgaagccaatagtatgggtctctgtgtgtcctgtgtgccctgagtgtattttagagtagctgttgagtctgctgccttatctgtgtgttatgaggtcaatgcactgatcacttgctgttttcacttctatactaactctaggcacactctactcccggtcaaaagtggattgtatatgtcctctttgatgtgatggtccctttggttttggtgcctcttccatgagcttcagatcagaactagctatgtggttccaggctgccttggtttcatcccttgtcttgcctacttcacctggctcaggagggacatcaaggaggaagaaatggataaagtcctggagggacttcaaacagtatttgacccattccagccgccatgactcccaccagcttcgcagcagcaatgccttcctctttgatgcacaggaagacccctctgctctggatatagccagtgagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaagtctcaagtacaggtccctggtgggtcaggtaatttgctctgttcctgtcctcacctcagtccctctggccccaactggcatctgcaagccagtatactcaaagctggccagaatgaagagagtgaagagattatggcagactctctgccactactgccacacatgtacaaatccgcttaacagatctccttctttaaaatgggacatcttatctttcctgaaatatatatattttttgagacagggtctcttgttctgtcacccaggctagagtgcagtggcatgatctcggctcaccacaacctacaacccagggtcaaatgaccctcccgcctcagcctcctgagtggctgagaccacagatgcatgccactactcccggattttttttgcctttttggtagagacagggtcttgccttgttgcccaggctggcctcaaactcctgagctcaagcaattcacccacccctgcctcccaaggtgctgggattacagatgtgagccaccacacccagccttcctgaaatattcttgataattatagttcctgaacagttttcccaagctgttctagccatcccaagaatgttggcaggcttctccatatgtttggaggtgtaactataatggttcctgggtttcaagctccagtctccatctcccctcaggtgcttgctttcccataagtttccatctgactactagaatatcaggggatttccataaagacaagactttgatcttggcaaccctttggtaaatagccagggttctcaatctttgtgcagcaccaaggtatttttaagatctctgttagtttagtctcagtgttgtaattcaatctaaataaacaacgaggctatctgctggagaaaaggatgaatctaacagcaatgccaccagcatgccctcttcccagaaaaactccacgctagccattggagcttctttaggtatataagagccctttaggttggtaacctcactggtgtgtgtatagattaaaaccttgacctatatctcctctcccttacttgaatgtttgactttactttgggggcaaaagtttggattgttaggggactatatgctttatatactcttctatgcaatagaaagagattgtattaattcactcattgagctttcacagtaatataaaccatattaggcttgtcattctgtcagtgatgggtgtaagtttgtggcttttattactcataccatcctctgacaaaggcatcctatttctctttccaatttcacaataaggtgcagaagaaggtctttaccatctgttaaagatgttcagggccgggcatggtggctcacacctataatcccagccctttgtgaggcctaggtgggtggatcacttgaggtcatgagtttgagaccagcctggccaacatgctgaaaccccgtctctactaaaaatgcaaaaattagccaagcatagtggtgcatgcctgtagtctcagccacttgggaggctgaggcatgagaatcctttgaacctgggagatggagtttgcagtgagccaagatggtgcctctgcactccagcttgagtgacagaatgagactgtcaaaaaacaacaacaacaacaaaagatgctcaggagagatgttttgtagagaggaagatattccctagtacccataaatcatctcaaggaggtggtcatatctttcctagtgctagaaaagccctattcagaaaccttcagtgtttttccacctcctgtcaacctgccttatacttcctgtatctccatgtgggaggcatccctgtggagtttgcttagcacttggccatgctttgtttgaaaccttaaaagctcttaaaggaagttgccttatgttccctgatgagaagatgaagttggcaaaagaatggtgaaaggcagggatcttgatgagaggcccctgactatccctttagtgatcagcatcttcatttcccgtctcattccatgtcctggtggaatggctgcagaagatgagatccagagacagcggtagcacctgaaggaaacccttttcatcaacaactgcctgtgagaaaagctggaatgtcatctcagcagctttgatgaagaaaatggtgggagaggcccaagtcagtgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgcctccaacttagaggtatctacctctaaaatcattcttgtgattcctaggctgtcttctgtcttctatctgctgctgtacactgcctgctgtctctctgcttcttatgtgattggcattcagtagaacccaggtttctgagcacctcatgtagcagaatgagagtctcctctgctgccatactcatcagcttcccttatgtctcggttactcttcattctaccaccccaaggtggttctctccaacccccctcctcttagattgttctcacacagaggccatcatttcataacattgtgctgggccggaagaaccataaccaggtcccttcccataccaaagcagtaactattttggaaaagcctccttcatattgcagccattggacatgataatacatgtgatgtgctggaatttgttaagaatcatgtgaaaattaagcttctgccccatcgcactaaagttccagccctgagtccccatggttttctccctaggctaagatagagaggaagaacatgaaatatgcagaaagcattctcttaagcaaacgtgtataatttgcctaaattgtaattatttcctggaacagcatgcacctctaaactctacaggcacatcatagattccatcgtccagctgtataatgaaaacagagttctcagagaacaccggagactcccccgacttgcctgaatcaagtttctagaggtaagcggtgaaaatccacaatatgaagtcactctcagacgggtcccttctcttgtcacactccactgtagaaacaaaagaggacggggaagccagagctgctcaaaaccttataacccacaattgtcatagttattctcaacttacacagggctgctttctagacgcaccccctccaggcccccagactgccaggctccaggaataagtagctctgagaaatatagtttttcggtggaagccacactccactattgcaaattggagaagagaaggacaaacttaaaaggtgaaaagatttaagagaacaacatggtgaaaccccatctctactaaaaatacaaaaattagctaggcgtggtgacatgcacctgtagtcccagctactcaggaggctgaggcaggagaatcatttcaacctgggaggcggaggttgcagtgacccaagattgctccactgcactctagcctgggtgacagagcaagactccctctcaagaaaaaaagaagaaagaaagaaagaagaaagaaaacaattgttttagttgaatacattttgtcaagattaaatcaactttcccctagggtactgatagaataagcaatcataatttagattctaacttactggtctttgagaaattgtgaaaacaaaaaaggtgccataagccaaaaaaggagcaaaagtcctaattttcaagctgatgaaaataaagaatgaaaaatattgaaatcgtcatagttcatcttggtccttggcaaaatacaaatctattgattgaaaatataatatcctagctaccttattgtgcctagctcttaccactgaggagaaaaaccaaacgcaaacaaaagtatgttcaaattggcaaaaatgtttacaaacctgcaaaatctcttcagcctatccctcaaactccagacttggtatttactaagctctgctgtgtacaatacccaccttaatatccattcttgcacaagttctgttaggtataagccaagatcacatgggattttttttttttttttttttaccctctcatgcctatgtctgcttttgcttccaaagacccttctgagtaaggactgtcctcagactactggagtcatttagtcacaagcttgcctgaggctcagagctggcaatacctgggagtttatgtcaatcccacagcacccagcaaccttgcctgcaaattatttacccatgattgacaggtgcaggtgtatgaaagtccagctccttgacttgaggggtgcctttgtggtgaattagctttgggaaaagggaatccagaggccaactttgtaaaactccagatagataaatggaaagaaatctttgccttggaagtccagttgagaaagatagtgatttacttcagactgtggaaagagagactaaaatctttactttctcatgggaaagaagcctatggtgaaagagaaacaaagagaatggtgggaaatagggtgggtctactcagtagctttaaaccattctgtcatattataaagcctggtgaggttttaacacaagtgcctggactctacacctagagattctgatttaaatgcttccaggtgggtggaagccactagtagtcttaaaaagctcccaagtaattttcacatgtggctagagatgaaaaggaccatctatctattagaatgtcaagtcgccaacatagaagtgtcccaaatgtacagctacctcatagaaaaggcttaacaccacccattgatggaattttccttcctctcgccatggttttgtttgcatagcatggaaaaaagagaagagaaaaagaggtagatggatagattgaacctataatttgcctatgtagagcagtttctcaaacttatctgaccacaagatgcagtgagaaatatacaattctttgtgatcagtttttaaaaaatctttcattatgtgtaatccaaccttcctagtatttaaataaagcctgtagtagcaagcagtccactatattgatttcacaacccataacttgttcagaattgcaattagaaattttttttggccaggcttggtggcttgagcctgtaatcccagcactttgggaggatcacctgaggttgggagtttgagatcagcctgaccaacatggaggaaccccatctctactaaaaatacaaaaaaaaaaaaattacctgggtgtggtggtgcctgcctgtaatcacagctacttgggaggctgaggcagaattgcttgaaccctgggggtggaggttgtggtgagccaagattgcaccattgcactccagcctgggcaacaagagcgaaattgtttcaaaaaaaaaaagcaaaaagaaaagaaaaagaaagaaaaaaagaaaaaaatttttttcacttctgctcaacctttttatcaagcaaaatctcaaaagaacatttactgtaaaagaacattgacaacaaacatctttctgtgaatccttatttctgtcccagccaccatgacccaataatctctagagcctgttagtgttctccagattgaagccttccctctaactgctcctaaatctgtgatgtagtggaaaaagtttgaggccttgattctcatcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttaggagggttatttctctgcaaactatcctctctttcttatgacagctatttctgaatgtgcacatttgaggctaagcaaatcccttcctgggaggcgtgaaagacctttatttctctgcagaggagtattatggaaagtcagttgatgctgaggaggtggtagagacctagctaactcatctgcagcggctttgagcaaggcttttagaatcataaggtggctggggtcctgtgtcctacaccacaggccagctagttcatttcaggagactttcttttctatctattattactatcttcttctagactgtagttcactaccagagattatccacttagctgcactcagtttgcacctggcctgtatcaccacttagctctcactccagcctcagttaggtatcagcaagacctcaccaaagattattgtttcattgtatatgtgtgtgtgtttttgtttgtttcaggtaacaactgatgttggaactatgaaaagctcttctctacttttaacaaagcttagtcacaaacagttccccagttgacgagaacaactaaaacaacagaacaattgaaagtccaaatttgaaagctccatctccgagaagcaaattttacagccactccagatttgtattccaaatggatagtttgattataaaaatcacatcccttcagcctgcaaatgtgataactgcccaagagacagtgatgcctacatccatagataatcccctttcccccaacctatatataactggagtcaacagcagctggaggaaaatggcaaggacttgtaatcaagattaagttagaaaaacactgctgtagactgtttatcagctcttcagcatatgtccgttttccttgaaggatgagcgtttagaaacctctgacaataaagtttattttacacacattctcttgcctatcatttttttttgtacaaatcacaattataaaactttcttgctccagctaaaagcaggaaactcagtcacaaatgtgttcactacatgtataccacagaatgatagcaaccagtctgattgcatcacttgattccaaaattaaatgttagcactcagtagtgaaactacatgtatctccaactctggaagccacaggcaagatactcctgtttcctgcagggaaacagatctataagcagggcagcagtctcacacatgtacactcctgtgaaatccaaggaaataatgatagtgacacagggcaggcaagccccaaaactggtttgtagcgtgggaaatttctcccagactgtagtctccttggctttgccaagaaaagaattcaaggataagccgctggtgagagaaagcaacttttattgaactggtgctacttcttgcagagcagggctaacctataggcagtgtgcccagagttggtgcctgtgggctactagctagttgtatttagagccacttttaattgcatgccaattaagaggtaggttattcagaactttctgggaaaggggcagggagtttccagaaccatataaagtaacttccaggccattgccaaggtgtgttgccatgacatttgtaaactggccatggtcccagtggtagtgtctttatgctcataagcagtgagggcaactagaggtcactttcatcatcatctgctggtttcagcaggcttctccactgcaccctgttttgaccagatcctgctctgttcaatggggttgggaatggaaaataagtccttctggtctcctacctcatttccccatcagagattatatactcctccttaatcttaaggggcttgcagaagggcggaggttcatcttctgtaactgcttcctgctgatgttatgggcatagaccctgcctagcactggagaggtaaaatccctggatacctgttctaaaaggctcaaaggtaggatgtctttatcttctgggtcagaagaggggatgggttgaaagccttgtgccagcatcatctttacatggaattattgtaatctggaagacacaaactttacaaggaggttaaacaagcaaagagcaaagattagtaataaaaagatatctattaaaggtcctaggaagggtaaaaaccaagtgtctgctggtagagattcctttactgaattccatcagcagggcaaagcagtaagagggaaaacattataattaggaataagagaaaaactttcatgctcatccacagcatcatgttattattgttatctgtgcatttgcaaaacaatagctttaagtcttccgggcgtttgcaaatataggtcacagcatcgtcctctgacatctgtgaggactcataacaatctttgagggccgggggcggtggctcacgcctgtaatcctaatactttgggagactgaggagggcggatcacgaggtcaggagatcgagaccatcctggctaacatggtgatatcccgtctctactgaaaatacaaaaaaaattagccaggagtggtggcgggcgcctgtagtcccagctactcgggagcctgaggcaggagaatggcgtgaacccgggaggcagagcttgcagtgagttgagatcgcgccactgcactccagcctggggacacagtgagactccatctgaaaaaaaaaaaaaggatctttgagcctgggcatagtggctcatgcctgtaatcccagcactttgggaggctgaggcaggcatttcacaaggtcaggagttcaagaccagcctggccaacatggtgaaacctcgtcgctactaaaaatacaaaaaaaaaaaaaaaaaaaattagtcaagcatggtggcacgtgcctgtaatcccagctactcaggaggctgaggcaggagaattgcttgaacccagaaggtggaggttgcagtgagccgagatcgagccattgcactccagcctgggtgacagagcaagatttcatctaaaaaaaaaaaaaacaaaattaactttgaagtttaacagcagtgggggtgcttaataatgcctgataggggccctttccattttggttgtaattgattcttgggggattcttctttctaagtttttagtaagactaagtatcctggttgaatgggcgagtcaatccttttccttgtgggaggaggttacgtttcacttccatatgattgaagggccttttgaacctggcctaagttgataacctatgtatctcttcaacaaacagaacgtctaaagttaaaaagggccttccgagctgctcaggcgacccagcctcccatcgctgctgctctagtgttcggttggcctgggccacactcaactgtagggagcccaggccaagaggcagcctgggccttctgcattgcgaggcgccgggcctcccgcagcgctccgctgacgggctgcgggcgggcaggcgggaggcctagtgtgggtcgcggtcgtggcccccgccgccggccctggccgccgcatcatgaacatagatgtggagttccacatccggcacaactatacctggaacaagttgccggccaatgtgagacagtcattaagtggagatggctcatcatggaggtcttcatccttgtcttcacaagtaggctgaagaggaggaaatacaggatgtattggtcttgctgttcagggtggtagaggaggaagaaaatcccagtcgtctttgaaattcacagagaatatgaaaagcaggttgtcctgtacagtatctgcaatcagttacgatacagaaataacttaaacatgtcaagaaagatgaatgcagatactatgaggaagtgctaaagtacagccaagatcatctcatgctgtacccttaccatctatcggatattatggtgaagggcttgagcataacaccattttcatattatactgggattatggagaatattatgaacagtgagaaaagttatgattcattgcccaattttactgctgctgactgtctaaggcttctcggcataggaagaaaccagtatattgatcttatgaatcagtgtagatcatcaaaaaaattcttcagaaggaaaacagcccatgatcttctaccaataaagccagtggaaattgccatagaggcgtagtgggtggtgcaggctggatatatcacataagatgacatcaagatacacactttgcctgagaaatgtgcctgagaaatcagcttcatcggcaactgatactgatacaaatagtcaagaagatccagctgactcagccagtgtaagcagcctgagtctgtctacaggacacacgaaacgcatcgcattcctgtttgactccagtcttactgccttcttaatgatgggatatctttcaccagttcagagcactggtgaaggagaagcacagaggtattttgatcatgcatttactctgagaaacacaatactgtttctgcatcataacaaagatctagttgtgcaaactgcacagccagaccaacccaattatggttttcctctggatctcttatactgtgaaagccttcttggtctggaccctggaactttcagcagagttttaaacaaaaactacacgctgcttgtttccatggctcccctcaccaatgaaatccggcccatcagcagctgcacccctcagcatattggaccagctatcccagaaatcagctctgtctggtttaaacggtacatttatcatatcactggacaaggaccaccatcccttttattgtccaaaggtacaagacctcaaaaactgccagatatatttcagagttatgatcgattgctaataacatcttggggtcatgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaaggagagttcactcgtgtcaatatgggtgttcataaagcattgcagatactaaggaacagtggacttacaacatctctgcggatatgtcaccatgttgaatgtttccatccaacttgcaaatagaaaactcagtgatgcttctgatgagagaggaaaacctgatttggcttctggctcagatgtaaatgggagtacagagtcatttgaaatggtcattgaggaagcaactacagattcagcaacaaagcaaacctctggtgccacaacagaagcagattgggttcctctcgagctgtgctttggaattccactgttcagttccgaattaaactggaaagtttgtaggaaaattgcgctaaataacttatcaaaaaaaaatcattcatatttaaacatcttctcaaacgtcagcccattttctggcacaaacaaggaagcagttctcagtgatactatctgtccaaaatcaagtgcactcaaaccatcattttcttgtttgagtagcttgggctaccactcaaccaataaaacatcataatgttcttaattttctaaactgacaaggctatataataaaaggtacaaaatgtatataaccactcatcataggtaagtggcggattttctttcagtaaaggatttaaatactattatacttcaacagtcaagctagacttactttctaggtcttatattaatgttaattgagaactttcataattacttcctatataaagatgagaattatctgactttgaatttctatcatattagtatatactttaagtcataattgtgagtttgaaacctacatcaataatactatataagttctaaattaattgtaaaatattgtcaaaaaaattaaaatatttacatatcattatccccaccatatgcattggaaagagattattctttatgacatattctggtatatttcccgtgaatctctatctcttgtgaagtttcttcttatgcaatgcctggtcaccagggatctgtgaggttcatgatagaaatactaatagcagttactgaagtctgagctgacttgtgtgttgcagatgctgtgtgtcagagtgaagtattcttatacagtaaagtacatttacttacttaagtccaactgttccctagttttccaaggtcaaggaaaaaaatgagttataaaatggaaatggaaaaactctctctggttggctttgtggttattgcaccaatatctatttcttagaaattttcctgctagccaagtacagtggctcacacctgtaatccagagctttgggaagccaaggcaggaggatcccttaatcctaggacttccagacaagcctgggcaacacaggaagacatcatgtctacataaattaaaacatagccagtgtagcggcacacacctgtagtcccagctacttgggaggttgaggtgggatgatcatttgagcccaggaggtggaggctacaatgaggcaagattgtacttgatacggtttggctgtgtccctatccaaatctcatcttgaatgtccatgtgctgtgggagggaccctgtggaaggtaattgaatcatgggggcagttctttccggtgctgctttcgtgacagtgagtaactctcaagagatctgatagttattatatgggggagttttcctgcacaagcctctttgcctactgccacctacgtaagacgtgacttgctcctccttgccttccgccatgactgtgagtcttccctagccaggagttcaattaaacctctgtcttttgtaaattgccaagtctggggtggtctttatcagcagtgtgaaaacagactactacagtaaattggtaccagtagagttggggctgctgaaaagatacccaaaaatgtggaagcgactttgaaactgggtaacaggcagaggctggaacggtttggagggctcagaagaagacagaaaaatgtgagaaagtttgggacttcctagagactggttgaatggctttgaccaaaaacctgatagcaatatggacaataaagttgaggctaaggtggtcttagatggagatgagaaacttgtcggggactggagcgaaggtgactcttgttacgttttagcaaagagactggcagcattttgcccctgccctaaagatttgtggaactttaaacttcagagagatgatttagggtatctggtggaagaaatttctaagcagcaaagcattcgagatgtgacttgggtactgttaaaggcattcagttttataagggaagcagagcataaaagttcagaaaatttgctgcctgacaatgtgatagaaaagaaaaacccattttctgaggagaaattcaagctggctgcagaaatttgcataagtaactagaagccgcatgttaatccccaagacaatggggaaaatgtctccagggcatgtcaaaggtcttcacagcagcccctcccatcacaggcacagaagcctaggagaaaatggtttcatggtccaggcccagggtctccatgctgtgtgcagcctagggactccatgccctgcgtcccagccactccagccccgactaaaaggacccaaggtatagcttgggctgttgcttgagagggtggaagctccaagccttgacagcttccatctagtgttgagcctgcaggggcacagaagtcaagaactgaggtttggaaacctctgtctagattttagaggatgtatggaaatgcctggatgcccaggcaaaagtatgctgtagggggcagggccctcatggagaacctctgctagggcagtgcggaagggaaatgtggggtcagagcccccacacagagtccttactggggcaccacctagtggagttgtgagaagtgggccactgtcctccagaccccagaatggtagatccactgacagcttgcaccatgtgcctggaaaagctgcagacactaaacagcagcctgtgaaagcagccaggaggggggctacaccctgcaaagtcacaggggtggagctgcccaagaccatgggaacccacctcttgcatcagtgtaacctggatgtgagacatggagtcaaaggagatcattttggagctttcagatttaactgtcctgctggattttggacttgcagggggcctatagcccctttgttttggccaatgtctcccatttggaatgactgtatttattcaacgcctgtacctgcaatgcatctaggaagtaactaacttgcttttgattttaaaggctcacaggtggaagggactttccatgtcttgaatgagactttggactggacttttgagttaatgctgaaatgagttacgactttgggggactgttgggaagacatgattggttttgaaatgtgaggacatgagatttgggaggggcccagggcagaatggtttggctgtgtccctacccaaatctcatcttgaatttccatgtgttgggggagggacccagtgggaagtaattgaatcatgcgggcaggtctttcccatgctgttcttgtgacagtaagtctcaagaggggagttttgctgcacaagctctctttgcctgctgccatccatgtaagacgtgacttgctcctccctgccttctgccatggttatgaggcttccccagccacatggaactgtaagtccaattaaacctatttcttttgtaaattgcccagtcatgggtatgtcgttatcagcagcataaaaacagactaagacagtactccagcttgggctacagaaagagaccctatctctataaaaataaaataaaaaatgttcctgctattcaatactacatcgtatcttcttcaggatagttcatttgggaatcgctaagtttacccctgactctagggatgggacatggaatttacacctaaaataatcagcgtctgaaaggacgtcccctctctggatatggaaaaggaagaactgcaggagttgtatgcagctgccttgcaatcccatgggaaacaatgctagctcacaggaaggcaaaagctgactgttgaaaagaaaccaagtccttgaagacattgttaggccccaaaccaatcaacccagaaacccatttaccactgaatctagagttaaataagcaagaaaatccccttttatttaatccagtctgagttgggtattctgtcattagcaaatgaaggcatcctgacatgtgggaatgtcaagacacacaagctcttgtgcagttttccatgcatggggacagtgccctggcattccagaaatcctggcttacttatcaccactctctaatcaactgcaaataacattttaaaactaagtgcaaagagaatgatcaggaatatcataaaatctgcatttatttaaaaaaaaaaaggagcttacagtgaagtagtctcaagcaattgctttctttttttttttcttttttttcttttattattatactttaagttttagggtacatgtgcacattgtgcaggttagttacatatgtatacatgtgccatgctggtgcgttgcacccactaactcgtcatctagcattaggtatatctcccaatgctctgcctcccccctccccccaccccacaacagtccccagagtgtgatgttccccttcctgtgtccatgtgatctcattgttcaattcccacctatgagtgagaatatgtggtgtttggttttttgttcctgcgatagtttactgagaatgatgatttccaatttcatccacgtccctacaaaggacatgaactcatcattttttatggctgcatagtattccatggggtatatgtgccacattttcttaatccagtctatcattgttggacatttgggttggttccaagtctttgcttattgtgaatagtgccgcaataaacatacgtgtgcatgtgtctttacagcagcatgatttatagtcctttgggtatatacttctcaaaagaagacatttatgcagccaaaaaacacatgaaaaaatgctcatcatcactggccatcagagaaatgcaaatcaaaaccacaatgagataccatctcacaccggttggaatggcaatcattaaaaagtcaggaaacaacaggttctggagaggatgtggagaaataggaacacttttacactgttggtgggactgtaaactagttcaaccattgtggaagtcagtgtggcgattcctcggggatctagaactagaaataccatttgagccagccatcccattactgggtatatacccaaaggactataaagcaactgctttctaagtgggatggctgaagcaagagaccttaaatcacttgaccgtcttcacaaaacagaactgaagcagaaccagaagtcccctgatagcctttcagggacaccacctacaaatacaccgtaatccctcatactccacatgccacttcagggaaagggacatgaggcaggaatacaaatatataccatctgtgacacttcctaagctcctggcttcagagtagccatcctgataattattttttaaagtccacattataaatgtgcaagttaagtgagttatggaaatcattccagatactggttcaccagtaacatcagtttagccctaaatattgtcataagttctctgataggctcatgtgatttaagctggtgctctgccaagactagacttaggcgttttatcctttttatgacattatgtatgttgaagagaatatatgaatacattttatatatatgaatatatataaaaccttcattatcacattattctcaatccagcattttctcagcccctgattttcatgttagttcagcattcttacatctttacagattttcatctaagactacatttctactgttttatataatcagcccccctaagatcaacatgtccacattttttggcaaagacaaagcctactgatttcaggatcattcttttcctttttcaaaagcacaaacccaaactgagaaataaatcaagagaaattctccttttttctatgctaatttagaagtagagtctttatttcttttcaaacccaaagagaatcagacatacaatatgaatttatctactttcgcttgctcagactgagaggaaagattaatattttcaggctgttagtcaaaactgttcattcaaatattatttaataaaatccaagaaccagctaaaaagtcgcttaagctaagaaaccttcaccagcctcatgggaaattgtgtacagttttctactagaatagcctataaatgcttactgaaaatgtctaagttcatatcttggtaactaacattttaattcaatctgcagaataatatatgcttctttagtgctaagatatgaatattagaggcattctttcttaaaatttctatttagttatactttcacaaataactataatattaaaattctgcatgtggcataaaacatattttaatggagaaggtaatgtgtagggagtttatttctgtttgctattagaacttatgtttattcttggttaaaaaaactgcactgattacaacatagaaaaaaacaaaagtatgttgtatatctcttacagtagaagataaagagtagttctaaatttagaaaggaaaaataaatatacacagtgaaaatatgtgtcagtgagatgttaatcaaagatcaactattgctgagaccagcaatattaaatccctgcacaattactcatattataatgagaattttaaaaagaaaatatgaacacataacataatgaaggcagaagtcactctcatccttcatctttgtattcccaattcaggaagctggtatagtatcttcattataattactattcaacaaacatttgtaaaatgaatgaataaggaatgaatgatgagaaaaatgataaacatctccctctgtctcctgggagttaactgcactactttctttcaaatttaattaatcctcaatgtccttgtaaaatagccaaagggaaaatgtatttacattactctaaatattgatgcaatctacaaaaagggttaaacaacttcctcaaagtaaataaaacgttcacaatccagctaggataaaaggatttaaatcatttcctaggtagagggctttcaattagagcccctgctgcattaaccatgggaactcatttcactctcttcatgatggagccctgagtgttgctgctaatctgtactctaccattctaatgcttttaaggttccttttcagcccttcctcctcgtaatccacaaatactgagaccaaggcattttttgggtcagtcctaatttcaagcattctatcctgccctccccaaatgaactcacacttattagaccatatgttcctatattagttcaggaagggggaaaaaatgttcatcacacttgtatataagagatcatagaaaaacagtttactaacctgtgaaaataccattcattctctgtttacctctggtccacagctaagcaatcagtaggatataaatgtaccctatgttcactattcagtattcataagtatactacttatgaattggaaatctgacacaacatttacatgacctaattttgaaaatttaaaatagtgtaaggcccctaggcttaattttacaggggaaagattaaaaggacacaagcaaacatatattctctctctgtgctgtgggacactggtaattttttgacttaaaatatttgatacttaaaatgccaaacttctacatttctgcagtaacaaggcagttatcatattgaataccatttctttctctccagtaagtaaatattagcacatgaactgaaaatattaagtgattataaaaaagtccaaataaattcattaaaatttagcttggcaaaatgttagtttcatgttcttggtagaagtccttttatatttatattcaaatgaaatgaacaatttacaagcaaaggaaatggcatcaaatatttgacaccctgcctcccaaggtgtattgattcatgctttttgctcagatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgtagtcaaacctgtaagtcaaaggatatgaaataatagtaactacacattaagcacagaagaaaatgaaacaaacaaaaaggttttaaaccaaccaaacatatgtcttattttggatgttctatatgttcttacattctctcaggtcttttgtgtcgttatgaacacaattctaacaagcttgattattttatttccattcacatattacaggcaacaagctgaaaaagtagaacagggtgtagagagacaggacaaagtacagattagggcttgaagtgcccctgaccagtcgacagcaaccacatggaataatgactcatgtgcattaatgatcacactaaatgatatttgttttttacctagtccttcaactgacagcttaaagaacttcaggttgttctgattcttgagtctcctctacaacttcagagaggactttcattttattttggatcaaatgctccacaactagttgaaactggaattaaattttatatgaagttcctagatgatttaaagctgtaagaagaagaataatgaatcataagaaaacttgctgctacagatatcaaaaaggaatgttaccatccctcatgctaatccttttcattttaaataaacaggatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttatatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttagggaatgtgtgcaaaccacacacttaagcaagctctggggaatgagagttggggggaatcaactgttttatttgctaattggtatttcctttaaaagatagagttcttccagattttaactgtgttaatagttactctagaaaaattggagatttgtgtgcatatattttatgttgtaaacagacacatacccagagacactgagagagacagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttgtgaaaaaaatgaataaagggcaccgatccagagtattgaagaaggcagagtggagagcctagtaatgagtatctggtaccccagtatcctctcccacagaatctgtacagctctccgtttatgacagtttaaacttaatttaaattatcaaacagacactttcctcaaacatataaatgatgaggcagttcattcaggctgtatgtataaagttgttccagccacctttttctaacggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatctaccactgtcagcaaaaacatgaacttagccctcaacagaatatttcacttcattctagtgtcacctctgcgtcacctgcactggagtcaccacttgcctgttgggtaagaccaggatgcaccgctgaaataaaaaggggtcaaacaatacaagaaaagccagtagaaattgccaaatgtatcagaatacacacaggctttctaaggatatggcccaagaggaaggctctagagcccaccctgaaacaggatttttgacttcacagagaaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaagcaattaacgctggcatctgataacaacgaaaagtatggagtctggagaatcgctagactctaaaaattataaaggtttagacttggactttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtgacttctccataggcagaaaactagcgtagttttttttattagaaattgttattcaataatagtacatgttacaaataaataccattttaaactgaaaaaattgtagactttcaaatcagttagggtggtcaccctaaaaaagggcatttttttccccttagtctccttgttcatgttgctcacaacaagaaatgggctaatgctatgaataataataacaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatatgaagatatgtttatagcaattgcatatacatagagagatagtatgtagtatgaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagctaattttatattttcctgattcaaatttatatgcctgtgtaatgttccggggtttttttttttaatttctgtaaatcagaatattcagatgttgaaaaagtctttgccttcagatttaaaagatacctttgaaatgtagcatatcccaaaatgcaacccagaggctggcaatgtcaacatttttctgttttaaaaaacctcttatgaaaactattgccatactaaattttttacttgctgatgacttacagctggaaaggattctgtacatataagacatcaaatattgaggatactggaacttttaaattaatggaaaagaaagtcaacaaaggaagttcatatgaaatcaaactagtaatatgattacaaaaaaaaaagtttaaaatttttcttggccccagtcttatcatttctgagccaaatacaattctatcgaaatcacctgaaactgaaatcaccattctaggctggttttcccataaagatggactgctccaaaaagaggaatcaagaaagaatttggctcacagtgaattattcactttgtcttagttaactaaaaataaaatctgactgttaactacagaaatcatttcaaattctgtggtgataataaagtaatgaccgcttttcagctggagggactaacttttttttttttttgctgcatatatagctgtggtacattttaatgtgaaatgatgactgcatcagcttatatccatggagcagattttagcattcagcttgggtctcccagtcaatatctacgagtctcttcttaaggagatcgatgacacagatacatacagactaataaatgtgataccaataatcaagaattcactcagttaagattttgcccactgagttccacacaagaaacctagaatttactagattcttgtgcctgtgaggctccactcatttccctgaatcacaaaagctacagagtatttagatagaaatatacctactcttaacatgaaccattttaaatatatgtattactgtgtccacaggagtacactttaaagcagggacttcactcttcaatctctccaatcatgtgttacctaaagtggcatgtggttccctaaagcttaataactgacattgccttaaaaaaggggtttgcttcccaactaatgtggaaaaagtctgaaaaatgattttaaatctttcactaaatttctcatttggtcacgtggaggaaaatgatttcaccaaatagatactcttattaattttttaatgtaatttatcaaagaaatgaaatatttagataaattccaggtttcccccaccatgagcttctccgaaagtatactccatcacagactgctcactaagaagctctactgcagtcaaagtgaccgaatttaaggggacataatgactacttctgctacacagaaacattatccatctctaacacttccctatgagacggaagacggacttctaatcaggtaccagagagggctctgccaacttcagggctttgatgaataagaatggttgagagcgctcatcataaatgaattcagtataactgagtgagaaagtgagagaaccagagaaataaatcctcatgtagaaaatttaggggtgtgaaatgccaaatgccagttaaccaaagctttctttgtcataaagcaacttctataaaaattgctgaaaataaattcttcatggctcaatgtgaatcagtaatttccatttctattacactgttgtttacccaaaaactatttttaatgactaagactcagagtttgccaaagtgttttccacaaaacaactgttttgagatactccagatctgtaatcaagtaagtctgaaaaaccccaaatacctcactcacctcttggatatgcataaagcacactaatatataacgttctaaaaagccaatcattaaaactgttttatattgtttaagcatttcctagacatatttggctacaaatctaacatctaattaaacagtttgggaaatgccatcacataatgtaggaatattactagtcatttaagaaactagaaaatatttactatattctaggcagttggctagcagttggagttctagtctctaaacaaaatactgacttatttctgtgacttttttcttttaatgtgacatcactcttttaagcagctctgtgcttcacaattttttttttcctggtttgttttccacttttgtctgtactttattccttcacagatgtgaaaggctaacaaatgtaaactagttatattaatcagcctctgcctcagttctacacttcaaatacagtatatactctatcaacaattcttggataataacaacctgtacttgtttttcaaacaataaaacaggccgggcaccgtggctggctcacgcccataatcccaacactttgggaggccgaggcgggcggattacctgaggccaatatggtgaattctcctctcgactcaaaatacaaaataattagctggccgtggtggtgtgtgcctgtaattccagttacttgagagactgagaggagagaatcgcttgaacccggggggcagaggttgcagtgagccaagattgcaccactgcactccagcctgggcaacaagagcgaaaactccatcttaaaaataaaataaataataaaacaatgatgaaaacacaactaactacagcacttcagagttagttgacaaatccaccttttcaatctacatttcaaaatgttcagaaagacaccatcctaggggaagtcaaccagcagcaacctctctgctaatttttgtacacagaaacttgacctgactgcacaaagatttcaatagatgtctccctctaaaattaatattggatgatttgtcatcttccatttaataccaaaagggtatcagccacaaactgaaatatcactcatatgcaaataaataacattcaagacttttatcgttgtggttattaatcttgtaatggatggacataaatctatttacattctcatcctatcctcaaatttcactattctctcctctcattcttactttgttctactcatattctcactctatcctcctatgcataaaatattatgtattctaatgaacagagataccattcgtgggcaaggaaaaaacacaatgaactgctctttataataaaaaccatgatcttgacacagatgttatcaatcaataaactttacacagctttacactaaattaatacaaactgctgatgagtgggtggggggtggtcactaagcaaacagaagcatgtaggtgttaggaagcacgagaaacatatatcagtgggtagggaaggcagctctcaaaggccaagaatataagttttaggtctatatggaaaaagctgtggtcacattcgaaggcttctgaacagaagaatgattaatttcatgcttaaagagttcaggtgtaaataaactggatggataagaaactcaaaatcaagaattttaagacactgggttaaggtgattgagttaagtcaaagccaacagggcatgggctaaatattgacatgggatgggatgaagaggccaacaatgtttcaaagtagaggttgccagagcttcaggaaccagaagaggaagacttgaggtgaaatctgaaactgcaatccccatgcctggctcaaaagatgtgatactgactaggaaaaggctggagagagaagcttcttttaaagaggtaataagggattgttttgatgtgctgggttgaggtgaaaatgacaaatattcaggtggaagtgtccagcattcaagtaggataacttggaacagaaagcccaaattatgtcatggtgaaatgaggataatgtcttattaataaaaacacgtcttactagtctttcctggggaacatgaaagatagaatttcagaaatttagagaatgaaaaaggaaagattacaaggcaataagttgattaaaatactaaaataaactaatcagtggcagctatcttaaagcaagatatatcttctacagcacgatctacccaaatgcaaatctgggcagagaaatacaaaatatttttaggactgacaaaatttcagctatatgtctttttaaaaatgctgcagagagaaatttagatggattggacaaatatttgcataaggattccacagccaacgtacacaattttccaactactatggttagcactgggctcagacactacctttgccaaccagcagattttcagtactgcccctggcagacatcccattagcaatctctccccattcccaaacattcccaactattctagtcatgccaattcaaccaatgtcccttaagccttacataaacattgacttacaccgaaatgtatcctatggctcttactaactgtaacttacttaaatcactcaagcctctgttttccctgctataaaatgtaaaatagctgacaaaatacctatttgtattttttggaaacacgggataaagcaaggcaagcaaaaagaacagcagagacaatgcttaataaatatcctagtaggatcaccttaatccatgaagaaaatggagtttaatttttttaatacaaaaaaactcaatgaagttatacttacgttaaattggtggttattttaggtcagtggttttaaaactcaacaatgaaactgttttcaaaaagagttgttatacagaacagaaaaaagcagccacaattttaaaaaagatatgaagacccagattctgactaactcattcagctcccttcatactccctccccacagccacctcagctcctgaggcaggttcccagggctccaaggaacatacttttaaaaaatcagtattttgaatacataataagtgatgtaacttaaaagtatggtgagaaagtcccattgccaagagaaacatgttaattttttatttaaaaaatcatcactcttttcattgtgacatcttgaagaatgctgaatggcttcaaaataactgcatatgccaagatttctggagtgggcacgtttgatcttctttcataatgaaaactgacaaacctttttagggggatagtattgtttcttcactctcccccctcctcacccctgcacacacatacatttctccttcctggggaactccaaagaaaacaaaggccctttagcaatcaagtagattgtctctcttgatggcatcccatgagttatggaattacatactgcaggcccgggtggattagggcccctagaaagtttgcttgatcaacagagtgctgttgattttttcaactgaattaattactcttggagtccaaactctccagtgtgccacagtcctcatcacttcctgtatcttaaatattgcattatctgtcccctaaaagtatttgaacatgtgacccagagaagaggacttacaacttgactaggcaacttctgttacactggattcatatgaaattccactgcaagtgacatcaccagattggggaccctgaagtgtttgagtatcttctccacatctggtcatttaggctaagaaattccttcttgtctaccaggtcttttagcattcattgtgtaagtcattcaacacctacttactgagaaggaatactgggctagacagtgtgctagggcctggggaaaccgcaatgcataggagagaattcccatctccaagaggctcacagtcaaacagacataaataggtgattacaatatacactaacaacatagttttagaaacaactagcagaattatatagacgaagatgccaggaaaggcttctcagagaatctggcttggcaaatatctcaacaaagagggctgagcagggatgagccgaaggagaggatggaaagtaggttgtgggtgagttttccaggcagcatgtgcaaaggtccaggagaaagaggaaggagcctgtacttggaggaatattcgattactattatcagtgtcacacttgctattcatctagacagaagctcctgaaacaaaaaggatacacttcaaaagatgccaatatatccatgaccacacaaaagagtgtctagtcatataataaagggtgtacataggcaggcaactcacatcctgccaaatattaaatttctaattttattataatttctaataaaacattagatttattattatacagagtcatactcctcgattgggaaactctcaactcaataaacattctttagtctcatgtcttttctaaaggaaagaaattaatgttatattcttgggtgaaaaaaaatgtgaggtctcaaaagagtataatacaatttggggatgcatatatattttacatgtatatagacacataaaaatctaaaagaataaattttaatatgttaacagaagacagaagtcatgtattttttactttcttctttttggcatatctctttttctaacttttttttttctttttacaaaaaacaattgttatttgtgtacttttaaaacctcacagtaatattttcacactaccttcttggctgaaagttcacactcggaattccagagcagtccatggccaggcccactgggctccccttgctctctccttggctttggtaaccactggccccagggactcagcctgctttcctatccatcccctcagtagctgtcaccatgcaggttaccccttctgtttcttctaccactaactccatgtctgactgcaagtgaaaggaacagaagcccaaacctttgggttttaaggagtttattgctaatctgtaaaacagaaagagacaggagataagcatgacaaaatatagggaagaaatgacttttgcctaaacttccaaactgtgtacaattgaagcttctgctttatagctcttagcacacctctcaaataagaaggcagtactgggaaggctctgaacctgtggcagaaccaccgatagctgtggagctattccaaggagtctgggaatcaggggaattatcaagatcattgttagaataaattaatcttactgtatatatagcagaagttttcaagcatatgtaaatgctactaataaccaaataattacaccttgtttttctttaaactgtaactctcaagtatgtctctacataattttttgatggtagtgtctgcatgctcaaaaagcttgaaaacactactggagaagaaggtctcgggagtgtgatgaaatacgtttacatggcagcttcatcatttaattggtgaaagtgactatgtgtcttaaactctctgagcctcagtttgcacatccaaaagcaaggatataattccatgaacctttccacctcaagtccacaaggcagaatagcaagatgttaactgccactctgaggaccaccaaataaaaggacaatttattaggccacttgccagcatggacacaatcgactcttggcatttcttattatccacagaaaaattaaaagtataaatgtagaacaaaattatcgtgttttttttaatagtaacatgtaagatcaatctttgtctttaaaataccgtgtatctcattcttggaaagcgtcaaaatgaaaatggtatagtaagttttatctacaacttgaattaaaattattcttgaaatatgttctgaatggttagatgaaatggtaattaaatacaaatagagataatcatatactctctctccataaggctcccacctccttcaatgaagtctagttcacctaaaatgacactattaacattaattcaatattataagttgataagcacattaaatcaaaacacagcaagattattttaagagtctgactgaaatgtcaggatgagaaatagattaataaatattggcttctaatgtcggtaatgaaaacaaacacgttattttcagaaaataaaaggtcttcaccattaggtacaaatcataaagggattatctacggttactacactgtaacaactttttacatattgtattatagaacaagcttttgagaagacaaagcaacacatcagcagtttaaccaattgtctttctcttttaacaggctggtctacactagattacatataaaaggcccaggtattacttgtgttcgatcttagccaaatggctgagaaacatccaggtacatttaaatcagtgacaaaagaaaacattatcccttagtaaaattacataaaataggaaacatctcttactttaagagcaaccatggtacttgttcctatggtgaaaactgatgttatctcgattagttaattattcatcccaacacctggtcttgctcccttttccacctctagctatgttaacactagagttcagtaattagctgataaagaatcttaactgcagtatctaacagatcttagtgattaagcatatgacttaccctttgtacagataagtaaactgaggcccaaagaactgaggtatcttattaaaaatcagagagctagttagttgaaaagtccacctgtccttcctttccacatgtctcaccagaaaaacagcaatggtgaaaagtcaactctgtttttaatgggccactttgtatattttaactgttaaaataatccaagaggatagtagtcatatacgaagatcctttagatataatgtgtaggaccagcattaatttaatcaaccaagtctcctctcattgaattgttaattcataattacaaagatgacattacagtaaattaagaaatactgtaatttcattctctccaaaaagtatacattgaagtttggtgaatactgttatattttcaactagtaaatcaatgtgccaattctgggtcttaggcatattgtatatactggaatgatattcactttaattaaatttgttttgagaagtagaatgtaatacagatcctacgtgtttttaaaagttcacatcaatttcaagcttttaaaaatgtatgtacacaagaaagcttcttttgcaatttatatgtttacaaatgttgccattagctaagctatattttggaatgtgatcaaacaatattgaatgtcaagtcttaacagcagggctggtctaaggaattccctctaagctaaatctgatcctttcatatgtggctactgctcttttaaactactgtatccctaaagggctaaaaggaagaaaatcctaacttaataagtgaaggcagcaaggcatagtatttgaatggctacctttcattttaactctacttcttaaattcaaaattggatttgggttcgtttcaagttgttcacaatttactaacgaaatgtgcatctctcattcttcccccaaaagaaagaagtcatccactccagctacatataagtctccaatttctgtcttacaactaaacgtgaaaaccgaaataccactcattgaaaaaaaaatgtacagagaattggcaggctgcatgtttatgtgaaccttcagaaaacgtggaaacacgcagccccaactcaccaggaaaatcaacacttgtgatcaaactattttgtgacattttatgtcttttatacatttcacttcatatccagtattccagttttgcaccggcttgcctgtatcaaccccaaatcgcctgagagcaatctagtactgtagcagaaccgtttcaacatgaagagttctgctcatcgcctgtggcgtggtcttcgaaacacctgaatcaaacattgattcccctccccctgctatttaaaaccgagggacgtcaggcttgggttgtaggtaaagaaaagccacagtaatcaaacaagcaaccaaaatacccgaacacggaacacgctaagaacaaaggaaacacaagagtgtgaacaggaaatgaagcaactctacacccataaataccttctggggccgccaacataggtaaaagtaaaggtggagtctgagtatctgaaatctgaaacagaaagtcctgtcaaaagctacccctggagtggatttgttttaaccccgatcaggacttgggcgctccatttggtggagtcaggggaggcctggccgggcgggtggcgagggctagagggcggcgaggtctctccgcgcagcgtcccaggggatgcggcgcgcccccgactgggtgcagcggcaggccgcccccggcagcaagtgccgggtgccatggcaacggcgggaatttcccagtcggggcggccggaagcagccccagccgggctcgcggcagcgaaagcaaaatccgatctctctcccgggggagcaaaatggacgaaaggcgaccccccaggcaggggcgctgggtgccttgggaatccgaggaatcccttctctttgccagtcggaggggactagatggagccgaaggggccggagatgggccgagcgctgccccccgggggtcctcggcgccgggcgcagcttacgagcgcagcgcagcaggctccattcccggccgccgccgctcagcccattacgcaaacctggcgggtccaaccaaccccgctctgccgccgctgctggaacccaggaggcgtgcttgcaggcttcgggcactacgcggggctggaaataccacgcactgccccttcgcctagacccccgctcgggccacgcgggttctgccctcaaagctggtagctgccccagacttgggggtggggggaggggaaggggcgaggctggcgccccctcccgcttttggctcccgcgttcgttgcagcagctgttgccaaatgaaccccggaatgcggacgtgcaaaccctccaccccacccccagccacacacgtcgcggtcagagaactgggaagggggcgcggggtccgaggttctggaaaagcaagaactcacctgcaaacaggcagtcctcagctctggacttctggatcacgacgtcgatatccttctgaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaagtggtttcggaagtgatcctgggtgagaggaggaggaggaggaggaggaggaggaggaggaggtggaggagaagggggaggtcggctttccatttccagatgtgacctcccagctgctgctcgccgctgctggattccaatttcctccccttctggcgatggattggtgatgaaaccgagtctcactttctccttcccccgcccggaccaaccgccgtggggggccgagggtgccggggacggccggagagcgatcaccggctgggcggcgggagccgacgaggggcgagccccgctccggctcaagcgcgcacacccctcacggcccgcactccggccttccacacccgtgcacactctcgcccgcgggcggcggcagccgtgcccaggctgctgcagcgccacccgcccgccgcggaccctccgcgccctccgcctagtcacccggcccggccgcgggccgccggggctcgcagagtgtcagccatcccgggcaggagtcgcgtctccccaccccgacctccactcgcgccgggagctgagcggcagtgtaggtagtgaagactccctggggctcccagccttccctctccgcgctctccccccatcacttttatgaattcgactccactttctaaaggaattatgagtcttgtggcaaacacaaaccggagtggccgggagggggaaaaggggggaaaagaaaatctttaaaaattaaaaaaaataataaaacgaacaaatctttacttgttgccacctcagataacacggaaaaagccttgaaattactccagatgtgcaccctccccttccctcagtgcctgagtctttttcctccagatcgaagtatttcagcccttttggggcgccgtttgcgaaacacagccccttttgagggacttcctcctcttgaaaagactcaccagttctcccttcctaggtgtttctgttcatgagaaattgtcagaatcaactggcacgttccagggtcttcctaaaggatggaaacctgtttggcttgctttttaaaaccacctcctttgacagtcagtccagggaaagctacaatccaggtgttcagaaatgagatactgctctgattctcactttctgttctgcctaaggacacctcaggctgacgtagctgccccacctctatattggtttatgccctaggagaggtctccagcaggcacttttcttattgatcttttctccgctgagaaggctcccaccagtagaccatgactcgttttgctttgcattctcagtgccacgtacagtgcctggaatacaggagggtggcctaaatgttggctgaatgcatgaatggtcatttcttgcagcctcttttcattaccctgtctcatcagctttcttatcagaataagtgcccaagagtgccaaactgtttcagacccttaatcaatttagttctgattctgaccgtgacaacatgatgttcagcacggtaggaatgactgccatctctgaaggagtcttaagattctgtagaatcaatgaaagattctatgttctaacgcctttatctttcaggaaagaaattacaaaatagtttcattgtccagtcatattcactatgagttataagaggaaacattctatctagaactagaaataccatttgacccagccatcccattactgggtaggtacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcacttataggtgggaattgaacaatgagaacacatggacacaggaaggggaacatcacactctggagactgttgtgggttggggggaggggggaaggatatcactgggagatatacctaatgctagatgacgagttagtgggtgcagcgcaccagcatggcacatgtatacatatgtaactaacctgcacaatgtgcacatgtaccctaaaacttaaagtataataataataaattttaaaaagaacaaaacatcacattgtacgacataaaaaaaaaaaagttggattttgcaaggaagatagacatctgactaaagtttggccaagcaaggaatctttgttagtactacttcttgtttaaggaaagaagagacattcatctttccttcaaacagtataagtctcttttcttgtttgatcaccttttattcattaaggaccagttgaatcatctgttgggacttggtagcagaggatatttcctggatagtgtgagctatcaggcctttaatgtgggaagtttagtttctataaaaataaaattaaaaaagattaatagttggaacgaactataaagacagtttctgagcccagagggcagctgatcaataagatttctagatgctgggcttttaatatcttcagctggagtgagaagaggcattggattagtttgcagtttgaatgccataaagatgggccacacacaagctgttgtggtaatttttctgaagcttatgtcaagtcatccagtttcagtttgaaggacttcaagaaaagaaaagtttataattttagtgattccaagctagaatagcaggaaaaaaatgaaatattaatttggagtattgtagctaaatattgtagtaaactagaaaaattgaggatctattgcagattgcaggcagataataaaacctcagaaaaaaaaaaaaaaacagctagaatctaatattgggtgcactgcagttttctcccgaaacataacttttctctctatattcactctcatttctgtcaaagataatcaaagtcagattgatttgtttgctaaataagtttaatctcattaaacttgtactgtttatgtacacaagtgcagttaagagtagtgattgaccatttaggctcttttaaaggttgcgtttgtcagataagaaatctcagattaaactttttgtttttgtttttttagacagagtctccctctgtcactcaggctggagtgcagtggtgcgatcttggctcactgcaacctccgcctcctgggttcaagcgattcttctgctcagcttcccgagtagctgggattataggtgcgtgccactatgcctggctcattttttgtatttttagtagagacagggctttcaccatattggtcaggctggtcttgaactcctgaccttgtcatccacctgacttggcctcccaaagtgctgggattacaggcgtgagccactgtctccagtcagattaaacttttaaaagccacttgaggctgggatacaagcccaaaacttgtcattagtctgcacctgttacatttatagattcagataaatttctctcttattgaggtccctaaaatatcccaaggtttccacacctgccaaacagtgacattctttatttacctgtaagtctgggaaccctagagccagtttttccaagatggtactttattggttccataaagccaaccttagtcccctaaagccttctggtcatatctgaaaacatgatgtttcagtcaaagccttggtgatataacctgtgtttccagtttgtcctgttacaaagacaacagattcttattaaacttatgcaaataaatactttgccataaaaataagaatatgcacaaatagtttccaaattctggagggataagttagggagaaaaagtaaatgtttccattttgcacaaaagtattctttactgaattggtgtaagctagagatagcttaaaaaaaagttttctgaaatctggaaaacaaaacatttaaagaactagcaatgtttccaacaaaaagtcattttaaaaattattctcatcagttcattcagtaccacgtaattaaatcttgttttgcttgatcttgggttagtagttacatgaacccgtcagttttattagagttctggaaattcttaccagtccaattgtatgatgttaaagttgttcagaaacctgtattccagaatactcataagagtattttccataaatctccttgaagaagaagccattttggactgtagctaatttcaaatgcttttagagaacaagtaaattaaaacaatgactgtctacagatgacaaggacttaaaatgtccatggttaaaaaatctaatgagagttcattacaatgatgcaatttataagaaaatttggttagcatggcatacagcattttaacataataaccaaaattatgactgataacatactagatttctaggaatctcatacaacttttgtacacttatcccaataatatatccataaatataacttaaagatggcttagcatcactttttatttgaatgctacacatataatttagcatattaaataaatctaattggtttaatctctctttcatacaaaaagaaatattctttgtggctttctgagggtccaatatggagaatcctaagttaatttgaggtcaaaaagacttaacttagaatgtgattttgggaagattgtcaaaaatgtcaaaaagtttaaaacatttaaaacaaatattaccatagttatctatttaataaaagctccattaaaagattttaaaggcaaattcagattacatagttgtgaacaagaacttagctcctttaatattgagaagactcacttttcttaagtaaccaaaacctaataaaacaacatgaaactcaagaaattatcttgacgaaacagtctctgtttctgaggccaattacttaaaaggaaaaaaataccctttacattctcagaccaacattccaagaaaactttaccattttaacggagaagatcaaattctacttttgaatcaatgtattactaaaactaagttttaataaaaccttataaataaatctatccaatctcagtcagcttagaccatacaagataagattttcacaatccttctagatatgttttcttatttacatttgcaacagacatacaccagacaattaagcaatttacttttactacatatcctattcttaggttgaatttatggttttatggccttaaacatctaacagtaacaacacaaacttgtctaatcagcaaagccaggtaaaataagtgtatgctgacagttctgaaaatgtttctatttttattttaccaatattttttaaactagtttttatttactaaggaatatcccagattatgtgaacctaaaaaaaattgggtcagtttctacttttctgaaaattttatacattcttatttgtttgagtgctcatttatccctagccaatttgggtattttagtttggtaataacgttggaggtagaaaaatatcacatatacataacataataacatagatacacacatgtacacatacacaaacatatagactgatgtaaccagatcttatgacttttcatttaaaaaattttaaccaggccaggtgcagtggctcatgcccataatcccagcactttgggaggctgaggcgggtggatcacctgaggtcaggagttcgagaccagcctggccaacatggcataaccccgtctctactaaaaatacaaaaattagctgggcgtggggcatcgtggcgcccggctgaggcacaagaagcacttgaacccaggaggtggaggttgcagtgagccgagattgccccgctgcactccagcctgagcaatgaagtgagactctgtctcaaaaaaaaaaaaaaaaaagtttttaaccatgaggcagtaaaacagagtaatacaaaaatacaaactcactggtttatctccaccttatattgttatccaaattgtgtttctggtgagaaagggataagttgagttgacctacataacaaaggctaaatctttttaccaatatttgtggaggaggttttttaagattttttttttttttactttatcagtttccaaatagtttctttttttctcctattatcagccccaggtgcttgtttttgaggggcctctgagtcccttgagagccccctcaaaggagggtaggataggggtcctgaagttcagcagaaaagaaacgggtctggcaagagtggacagagaaatagtcagcagagacttgagaagaggggtttcaggtgacagagctcccatgggagaagcaggatccaatagagagaagagaaagagcagagtggttttatagagagccaggaagaacaatttgtagctcagggaatcagggaataacccctcactcagaaaaagagagccagaaagaagagacttctagtctagggactcagagaatagatcactcagaacaagaagcccacaggaagaccttcctgcccagaggattcctttcaaaagaagcctgggactctaccccagcttcagagagaatattcatcccttaagattcaaaatctgtccatagccatcaacgggcttttgtgtggagcaatggctcagaaatctgattcaccaatggatccctaatcagtcagaaatgacaacaaagacttcaaaggcatgcatttagggtcctgagtgagaggcccaggatccagtgatgaatctgtttcaacaccataattgttaaagaaaaaattattcagtgatacttcaaatgcacagtaaagaagactttattcaggaccattaccatagatataggaaccactgcaatacagtcttggagctggggagagagatgggcttaactctgaatacagcacggggaagtgggaatttatagaccaggagcaatgcaggggtcagtgaatggaaaatcactaagaggaaacatcaggagtaagggagattctggctaaaccgccctaaaagaattcttgctgaagactggccagggtgatcagacatcacctgcagaatggtgaagaatgaagaacctgatcagatattgagaatgagggggtctttggtaaacttggcagtgttctttgctaatgctggattttgtgaggaagtgcacagtttagcctagctgaagatttagaagcctgactaaagttggccaagcaaagaatctttgttatcaacatattccatcaaacctcacatccctgccttaaatgatcaaaccatccgcactcctgtatgctactgttctccatgaaaagttacttcttctttgtcttaaccaaaatccagccattctagaaagacaccagaaggctttctgcagcatctaaaatttccccacattctaggcccaaatccttttcctttccctgttgcttttagatccacattgtgtaaccctcatctagaaacctcagtttcttggagtcattttttttttttgggacggagtttccgctcttgttgcccaggctggagtgcagtggcacgatctcagttcactgcaacctccgtctcccaggttcaagcgattctcctgcctctgccccttgagtagctgggattacaggtgcctgccaccatgcctggctaattttttgtatttttagtagagacagggtttcatccttttggccaggctggtcccgaactcctgatctcagatgatccacctgcctcagcctcccaaagtgctgggattataggcatgagccactgagccaggccattctgtctttttatataatataacttgtacttttatgtagtaagttatcacaatggtgtcagacactctgaggaagagtattttactgtatcattcccattacccaatcaggaagtcttaacaggcagattttaacaaaaatataagacacaactgtgcctagcttttctcacatacttcctacctcacacttcacacatttctttttctcagcacccactcttaagtaataatttatttcccctgaatattatttaccttctgtgggctaccttacatatcatctgaaagcatgatcaaaacagttatatttgtgaataattttattttggtttatttcttagcagaaggaggagttaatagtaacatttgtaggccgggcacagtggctcaagcctgtaatcccaacactttgggaggccgaggcttgcggatcatgaggtcaggagatcgagaccatcctggataacacggtgaaactctgtctctactaaaatacaaaaaaattagccgggcatggtggcgggcacctgtagtcccagctactcgggaggctgaggcaagagaatggcgtgaacccaggaggtggagcttgcagtgagccgagatcgcgccactggactccagcctgggagacagagcgagactccatctcaaaaaaaaaaaaaaaaaaaagtaacatttgtaatctcccagagattgccaaggaaaacattctcctggctgaatttatgtagagttcatcatctaagcataaaatattttataaaggaatgggccaatcaaataactgctatgcggttgacactataaaccaagttagcttagtaccactctaaatagttgctgggaatataatgattttcaaagacatgatctctagaaataaataactaaaagagaagcacggtgtcatgcatttatgcatacacataagcagggactagagatcaagaatagaaataaaagaggtttttacacttggggtgctaaggtcgcaatgatttatttggagagaaaacagaagcccttctttagtaaatgcaaagcaccatgtgtttaatgaagatacatgacctaagctttgaagatcgtttaactaattcaataaccttaccaagtatccattactacatctcaacaatcaaatttacagtgacatctttgagttaaatatctccatagatgtctggaaacagcttaattctgttaactgctgcccattgaattatgcttaatttggttgtagaatttcatgtcatctgttattctccctcacaacttgggagacgttattcctgtattgtctgttctcgttgatgaagagaagtctgtgataaagtaattgtccttcctttgtaggtaatctgccttccatctctggttgatttgaaaatattgtattagtctttagtatcttgcattttactgtggtatgtctacatatggatttatacttactgagtttgctcagagcttggagtatttcctcagtcttaaaggccctagttgtgaaaatgttactacagaaaaactttatttttttaacttaaaatcctttttattgggaaataaatgtaagattatagataagtttgaaaataaaagaattgttagaacaaaaaatactcatatgcctgttaccctaatttgtctattattattttattaaatttaggttaccatttgttctctctctctctctctcaatatatatcccaattttcagtctttagttctaaatctttcagcaacctggactatcatggccccagtgtaatgcttggctttgtacctcatgagggaagaaattttttttttaatcttaagttctaggttacgtgtgcaccacatgcaggtttgttacataggtatacatgtgccatgttggtttgctgtacccatcaacttgtcatttacattaggtatttctcctaatgctatctgtcccccagccccccaccccctgacaagccccagtgtgtgatgttccccactctgtgtccatgcattctcattgttcaactcccatctgtgagtgagaacatgcagtgtttggttttctgtccttgagatagtttgctgagaatgatggtttccagcttcatccatgtccttgcaaaggaagtgaacttatccttttttatggcttcatagtattccatggcacatatgtgccacatttttttaatccagtctatcattgatggacatttgggttggttccaagtctttgctattgtgaatagcaccacaattaacatatgtgtgcatgtatacatctttatagtagcatgatttataatccttcgggtatataccctgtaatgggatcgctgggtcaaatggtatttctagttctagatccttgaggaatcaccacactgctttccacaatggttgaactaatttacgctcccaccagcagtgtaaaagcattcctatttctccacgtcctctccagtatctgttgtttcctgactttttaatgatcatcattctaactggcatgcgatggtatctcattgtggttttgatttgcatttctctgatgaccagcgatgatgagcattttttatgtgtctgttggctgcataaatgtcttcttttgagaagtgtctgttcatattatttgcccactttttgatggggttgtttttttcttgtaaatttgttgaagttctctgtagattctggatattagccctttgttagacgggtatattgcaaaacttttctcctattttttagattgcctgttcactctgatgagagtttcttttgctgtgcagaagctctttagtttaattagatcgcatttgtctattttagcttttgttgccattgcttttggtgttctagtcatgaagtctttgcccatgcctatgtcttgaatggtattgcctaggttttcttctagggttttttatggtgttaggtcttacatttaagtctttaatccatcttgagttgatttttgtatatggtgtaaggaagggatccagtttcagctttctacatatggctagccagttttcccagcaccatttattaaataggggatcctttgagggaagaaaattatttctaatattttaatccagctatgtatgtaaaaagaagtctttttcatattttatctgttatttctgtatgattggagtatgagtcaaaacatctcaatataaataaaaagttacatttcagtaatttttttttctaaaattacaaaacactagtggtcaaaaacactactatttccaattctctttcctttgttaacattactttttgtacttatgagagaagagtttgcaatccaaaaagagcaggaaggaagagagattagagattttttctcctgcttgctctatacatatgagatatttatatatctatatatcaacacttgacctttgaataacactggtttaaactgtgtgagtccacttataggtggattttttcagccaaatacagattgaaaatacagtatttgtgggaagtgaaacccacatatgtggagggccaacttttcatatgcgagctctgcaaggttgactgtaggacctgagtatgtgcagacttcggtatatgcagggctcctgaatccaataccccactaatactgagggatgactgtatatgtctctatctatctactctatcatatatatatatacacacacacacacacacaaatatgtgtgtatatatatatgtatgtgtgtatatatatatgtgtatatatatatacttcctatattactttgctagggttgttataacaattactgcagactggatgagttaaacaagagaaatttattttctcacagttctggaggctagaagtgtgaggtcaaggcatcagatgtgttaattttattctgaaatttctctccttgccttttagatagtcattttctcatcttgtcttctcatggacttttttctgtgcacatgtttgtctgtacctaaatttcctcttcaaataaggacaccagtgatattggattaggacccagacatgtgacctcattttacattagttacctcttaaaagtctctatctccaaatatagtcaccttctgatatactgggatggcagggggcagggtacagcatattaatttggggaaaggccacaattcagcctataacatatgcaatatattcttctctgatctatactatataacttttatatataatacatatataatttaatatacattttaaccccttgattaattttgtcactgcagagaaaacaagaattaaagaaaagcttcaggtgatactgtttttgaatgagtaagaattgagcctgcccttaacacaagaatgaagtagaaataaactgacttagggaacagcataaaaaagttctcttatgagtcaagatttcagtgtgatgtcatcattttttccagggattaaatattagaatatattgcatgcccatattgaggtggaatcataaacttatttcagacttattataatggctcattttcttatgccttcaccattgaacttgtacttagctggggattgagctgaaagtttgccttttctgtatctagcatagttgcaccaaatctgaccttaatcccaaattttcctttctgtaatatcttgtttccaaatgaggctcacattgaattttctcttgttagaaatataactggcaagaccaatcaaaaccattcattccattcagttgcctgtgaacaagcttgatttgctttgttattaatacagcttcttgtgggttaagtagaaagctcttttgtaaatatccctcagtttaagtatatatagtttacatttccaggtaaactgtaaattctctgagaaaggcccagcatggtggttcaagcctataatcccagctctttgggagtctgagatgggtggatcactggaggtcaggagtttgagaccagcctggccaatgtggtgaaaccccatctctaccaaaaatacaaaaattagccaggcatggtggtgcacgcctgtaatctcagctactcaggaggccaaggcaagtgattaaacccaggaggtggaggttgcagtgagctgagatcgcaccactgcactccaacctgggtgacaagctggactctgtctcaaaaaaaaaaaaaaaaattctgtgaaaagatctgtgatttccattctcctttatagtaattgttaagcactcacaattagatggttataacaactatcaaagaaaaacaattattttaataaatatttttcatcattttctcctttctaagccctatgctatgcactaaaaactgcagagaaaatcaacacattctctacctcacagcagatttcttggagagagataggggtggggaggggaataagggttgctaaatgttgtcaactttgtaatacaactctcaaagggagatagttattagggaggcaaagtgctcaggctcagatttcaggttgcctagatttgaattctgtcttcactgcttcttttatgatttgcccaaattacttaagctctttaaaccacagtttcctcatccttaagagagggataataaatagaacttatctcataaaattactgtgagaattataagtgattatgaagttgattaaatttccccagtgcttcatacaaagaaaggactcaaaggatatgctagttcatagtaggggcatagaagaagatatcccttctctcctgggatatagggtatacataactgtccactataaaattgaagataggctagagaaaagctaaaaatgaagaatctaataactctttagccaagagaaaatgaaacatgagggaaagggagaagttccaaatgaggtccacattagtcgtgggccactgaatggtggtgccattcaggcagaggaaacccagaaggaggagtcattctgtagttagagggcacttaatgagataatattagagataactgaggttgagttgttggtacgtatctgggtgcaaagtctccataggtccggaattttgaatagttttctggagtcatctggttattgttaaagccaagagaattggtgagatcacagaatacaataatgatcaataagagggaagggaagagagccaagaatgggagactgggaagcatacacatttaattaaggtttggtaaggtgaaaggtgtcagcagagaatgtaaaggtgaaataatgagagaaaaaggaggacatcaaggagaaagtcgtgttttgaaaaaaacaaaaaggacacattttcaagaaagacattgtcaatagtttaaatgtcacaaaatagtagagtataatgcatttaaaaaaaacaaaatctattgcttttgttaattaaataactagtaacctcggctgcagcagtttcagtagagtgaggagagttgacaccaaactgcaccagtggagtgaaaataagtgggaagaaagagtgaggaagtggaggacagtctttttttttttttttaataaaaatattttcccaaactgtcttttctggaacttccaacatgtctgcttaagagcttgtcttagttgaattcattcgaacttcttgaacctaattagtttctttttgctgtttttttttttttttttttttttttttttgagatggatccttgctctatcgcccaggctggagttcaatggtgcaatttcggctcactgcaacctcctcctcctgggttcaagcagttctcctgccgcagcccaattagttttaaagacgctgcatatattggcagggaaaacctagaacacaaagtcaaacttccaattatctcccttcagtgctcaaatcaagagttcatttgttgcaaggaatggggatctggactccagggagaagaatagagttttaggaggaaagttctcctaaaactaaatggaaggagggttctttgagataccaaggatttgcaggactttatttacaatgaaatgttagtttcagacagcccaggaggaataggtctattaaaggaaagcaagagtagttggcgtaaggaaacaatttgcactggagcctgagagtgagtatagtaatgaccacatgagagacccatttgactcaagtacttcaaagcattgccagtgttagtctttgctccataatcaagtggggaaaaagtgaaatgtctttgaagagcatttcctgtaggtggcctttgaggaggtcctgaaaattccaaacctgcaagtattaatggcaaagaataaaaatttgtttatataaaatacttttaaaaatctttctaaatagcaagacattatatattatcattgttaaaagataaacgaattgagaaatatcattagaattatatgcagcagataaaatggtcacttttttttttgagacagagtctcgctctgtcaccaggctggagcacagtggcgtgatcttggctcattacaacctccaactccctggttcaagtgattcttctgcctcagcctcccgagtagctgggattacaggcacgtgccaccaccccagccaatttttgtatttttagcagagacatggtttcactatgttgggcaggatggtcttgatctcctgaccttgtgatccacccgccttggcctcccaaagtgttgggattacaggcgtgagccactgcgtccagccaaaaggtcactttttaaacttaaaaattattaagaaaacagtgaaaacttaatgtttaaaagagtagaagatagggaaaattattacacagaaaaagataaacaacagagaaagataaattgccagtgaatatgtaaaaagttgctcagcaccagtggtagttcaaatccaaatagcactgagttagcatttgttaactaataaattggcaaaaattatattttgataaaacccagtgttgttgacatctcaagaaaaagggctatgctcacacagccttggagcatgtgcacattgatgattttgttggcataaaaattagtggtttctattaaaatcagcagtgtaattcacaatcgctaagacatggaatcaacctaggtgcccatcagctgtggattggataaagaaaatatggtacatatatgtcatggaatactttgcagccataaaaaagaataaaatcatgtcctttacagcaacatggatgcaactcgatgccgttatgctaagcgaattaacacaggaatagaaaaccaaataccacatattctcacttataagcaggagctaaacattgagtacacgtggacacaaagatgggaacaatagaaactggggactactcgagggtagaaggagggagggggtaaaggttgaaaaaaaattactatgcctagtacctgagtgatcagatcaatcatgcagcaaacctcagcattatacaacatacccatgtaacaaacttgcacatgtacccactgtatctaaaatcaaaagttgaaattataaaaaataaaaaagaaaatcaacaatgtgtatttctctcacacagccatcacgatgatgtatttggaataatatatgcataaggatgttcattgcagtgttgtctgcaagggcaaagtgaaaacaatctgaataaccatcaatatgacacagagtaagtaattattggtacgtctctacaatgcctcatgcagtcaccactgacagcatgggaaagagagacatctattatgaaaagaccactaagacatatgattacatgataagtgcaaggttcatgaataaatagtatgtatactagtatagcatacttctttctaagaaagaaaccataacacatacacgaatggacaagaaattattaacaatagctaactttggtgataagactgtaggttgtaaaaagccagactttcatttctcattttaaacccaatgaattatttaaatctaaccctactgcattcattatctttataataaaataaatatgtataacaatgaaacatactttttaagtatttgggacataaattaaacattaatagattacacctcttaaacttggtactttagtatcccatttctctgtgagaactctgaaagcttcatcttccacagtttaggtaattctttggtgtcttattttgttattttcttgccctgagattagcaatgtcagatctccaaactactaactcttctctttggcagatcaaatgcttcttcttaaaaaaattgattttttaaaatgtatttcataggatttttgttctctctctccctctttttgtgcatatgtgtgtgtgtctgattagtctttattatcttaaaatggttagtcctgatagacctgtttcttcaaaatttctctcagttctttggcagtttgctcttagcttataattaaagatcaatttctgacttgtcttgttctagaaaacctcaatggaaattacagcaagctgaataggatattaattaaaaacataaacctggtgaaacccgaacatagaggctctagttcaaagatgcttccaatagttgacatggccattcattccttaaaaccagctatttttctttcgaattactttacctttaattctgtaaattggatgttatatagtaccatgaaaactgctgtgagtaattataatactcattgctgagtgatgtgacttctttctcaaggctatttctgagggaaattgtacaattagatctttaggtattgtgacttgttttggaaatcatggtggccctccagggagctaaagaatctttaattatttagaggttcacatgagaccccttacagatataagcacattagctctgtagctaagggaacatttaaaaacagtaacatgaaatgtgtcagacatagaggaaagatgaagaagcaagtagaagctaatgcaaacagaggaactgccagctctctgtggcactctagctctctctgtcagtatttggttggcaatgtagacatagtggatgagtgcaattacatatgttaggctcattctgaaatgcaggagcattttagattttcatgtagaagcctgacaagcaaactacatctaggatatactttgataactttgagttgagagccaaattttttgaaggtaaaccatctccctgttttaaagtagtgtttaaaattataaaaatattaatacatctgtaacataaaatatttagatataaatactacaagtgcaaatgaatttttttttctacttctgcattcaacttttctcttctccctttagggaaaacacttttgtgtaaaggcctccaaaatatatgtagagtcgtatgtatgttaaaaacatgtatacatataatgcataaccaaacaaatgaaatatcctaaacatatggacctgaaaattgcttataataaatttgaactgaacatataggcataaatgtggttcagaagtgtccagttgaagcaacttcactttgttaggtcaacaaaagttggggacaccaagatctactcctctgattttgttctagcattatcttaatggaaatgtttactgaaatggaaatacatgtagtggacatcgtggtggtgtctcaagcattcagtgttccctgctctcacacactcctagccaaataatgaatttctcagcttcacaatgtttaagtgacatgagtcccatgcccaattcttggtcattgtaattggtgcatgaaggaacatgtgccttctgctaatcaaatcagaatgaagtacaactttttcattccatgattgaagagggaaatgccttctttccaaatgcagcagaggaagcacgaggtactaggattggaagttgtctactcatgacatgatattttaagccatagaataaaactgagacctaatgtcttagtcctttcaggtcgctataccagaatatcacagcctggatggtttatgaacaacataaatttatttcttacagttctagaggccaggaagtccaagatcaaggtgtcaacagattcagggtctaatgaggatttgtttcctggttcacagacagctgtctttttgctgtgccctcacatggtggaaggggctaggaagttctctaaggtctcttttataagggcactaatcccattcatgagggctctgtcctcatgacctaatcaccccctgaagacccactgccaaatatcatcacactagggattagatttaaacatacaaattttggggggatacaaacattcaatctatatcacttaaggtagagtgaagaaacagggaggacaagaagcatttattttgtgtcattattaaacttctgcattaaactatcttgagcctatactattgttcaaaatctctttattatacaagccattttgaattttgattgtttgcaaccaaaattaacctaataaattaaaatgtactataatgttacatcataatttgtctgtactagtagtatttgctagaacgtttaggggaatacttgcttgttaactttttagtaaatataacactccatgttcaaatacatttggaaaatactgagcatttcacacttttagagactcaaaacaggcagcacatttttaaaaaataaaaataaaaccaaatagcattgcatttggagaatggtataaaaaaagagaatttgataaactggagttatcagaactcagtggatactatgtgttagacattattataagccattaaacattttacaagcttgatatctgagttaaaaattaataacccaaagacacattggaagagaaaagttgacatatttttattatattaatgacctaaaaatatcatagcaactaacatcattatagtcaacaagtgaatgaacgtaaataatattaaataactattagaaagtctctctgattaagcatggaaataaataggcagtgcttttgaccaataaatggaggagttacaatactttccaatacaaaacaaaaagattctaaatgtaaaggtattaggcccaaaatatgttagtcaattcatgacagcagaaattcagcaggtcatatttttgaggtaatgtaaatgacaatagaaatcatggactaaagtgtaacaaataagtaatatctaggcaggtggaaattttaagatcttttaaattaacttctggactatagcaaaaattcaaactaaaattcatcagggagtcagggaaggtcaaatgaagaagcatggggactgaggcaaaaaccctgaattataccaatattatcttttttttttttgagacaggatcttgctctgttacccaggctggagtgcagtggtgcaatcatagttcactgcaaccgcgacctcctaggctcaagggatcctcccacctcagcctcttgagtatctgggactacagaacctcatcaccaaaacacccatctaatttatttattttttgtaaagatgaggtctcactttgttgctcaggctgacaagtattatcttaatgttatagaaaaaaagtaattctggccatatataggtattattctttgcagtggaatatcatttcagaaacttgtgccaaacataaaattagttttctagtagtaaaaagtaattaaactctttaaattattattacccctagtatactggggaatgggtgtgtgttccaaatgaaaaaacttgggatgtctaatgagatgctgttttctgtcgtagaaaatctatgtaaaatgttttttctcacgtgtacactgttgatatttgagacagcacatgttaacacttcaagaagtaaaataaatgtgttgattatatccacagttttcatatttattaactacatatttcgtttttaatgtaatgcctattgaaaaacctgtaaatagttgtttcttaaaattgacaaatactgcctaagatttttctgtatattttcatatttcaattttcctgtgaggttagaatgaacattttagctaagacatttgtgcctccaaatcctaaacctttcagaatgttagtttattatttggtttttacctaaattattttctgcttattcaagaaccttaggtctatccagttacgtttttatttttttatttttatttttttattttgaaacaaagtctcgctctgttgccaaagctggagtgcattggcatgatctgggctcactacaacctctgcctcccaggttcaagtgattctcctgcctcaacctcccgagtagctgggattacaggggcataccaccacacccagctaatttttgcatttttagtagagatggggtttcaccatgctggccaggctggtctcaaactcctgacttcaggtgatctgcccacctcaggatcccaaagtgctgggattataggcatgagccaccatacctggctgtatccagttacatttttaagaccagccaggcttaatatatatttggtcttttgctcaattcaatttgttgcattttgtccattgtacttcatgtgacacagaatatatcttaatttaaaaagacatatgtttgttgagctatctgttacgttggtatatcttggaattttaaaaaatataaaccacagaagccaattatggctgacattaacaataaataggtttatcacagaaatagtggggaacttgtagaactgttgagaaggctagaaagccagatcaaagctaggcagccaggaaatgtaccccaaaccatgctgtagaactcatccagggaggaaaccactgtcaccaccagtaagaaataacaccgaagatgcagggagcaacaattgcagcaattgctcaatcctaggctaactgcaaagccaccagcaccactcccacttgttcgctttgcaacagatattgtagcagctgctacatggcctccaccagaaacaagagaaagcataactgaatctgcttctttttttattaattccgaagtggaaattcagcactggcaaacagattggcaaaacctaagtcatatgcttgtaccctagctgcaaaggaggctgagaaagcaagcatttggcattttagcttctaaagcaggaggtggtttcttgttttcgtcaaaactgagaggctgaggaattcctcaaacacagcaacaaacatcaaataataaatattcatgctttaacttgctcaatatcaatataaactttcccttttgaaagtaaacacgaaagacccaagcttccttctaacagagtgcaactatttctctaataattgaacatgtacctacaatctcttgaacaatgaaacaataaaaaattctcaatcacagcatgtactctaagtctaagaattctgggttatgtccattcctctacgaagttcttcactatactctcttgacattctgccatatatcatttaaaaattaagttaatcaccctcaataagccctgttttaaaaagagggataaatggagaggaaagaaggaaagttgttaagatacataagtatgcacaggacaatacaagagaaacaatgtgtttggatgtcaaggctctcctttctgcaagtggccagcaggtcactattggcatctatggccatgtgccctcagctaacacctctgctagtcagggttttgccttgtgagatgaccaaatattcattcctgacagagaaatgtccttgataatctttttgtgtgagcgtgccatggtcattgttaatttctttcatttaacaaaataatagactttattttttgagcagttttagctttatggaaagatcgagcagaaagtacagagttctcacatactgtcacctttatcccacccccagtttacattagggttcactctttgtgtggtacaggtctaggagttttgcaaaacgcataatgtcatgtacccatcattacattattaccaacgtattttcaatcccctaaaaaatcgcctgtttcagaactatttatctccctacccatccccaaactcctggcaaccactgagcttttttgttgttgttgttgttacttagtttttatttcataatcataaacttaactcaactctgcaatccagctaggcatggaagggaacaaggaaaacatggaacccaaagggaactgcagcaagagcacaaagattctaggatattgcaagcaaatgtggtggaggggtgctctcctgagctacagaaggaatgggtctggtggtgaaaataaaacacaagtcaaactcattagaattgtccacagtcagcaatggtgatcttcttgctggtcttgctattcctgtacccaaagtgctccatggcttccacaatattcacacgttctttcaccttgccaaaggccacatgcttgccatccaaccactcagtcttggcagcacagatgaaaaactgggaaccatttgtgttgggtccagcatttgccatggacaagatgccagaacctgtatgctttcggatgaggttctcatcatcaaatttctccccatagatggacttgtcaccagtgccattatggcgtgtgaagtcaccaccctgacacataaaccctggaataattctgtgaaagcaggaacccttataacgaaatcctttctctccagtgctcagagcacgaaagttttccgctgtctttagaatcttgtctgcaaacagtttgatggagatgcggcccaagggcttgccgtcgacggtgatgtcaaaaaagacgacggagttgaccatggctgatagtacagggctcacagtgatggtggcatctgcaaagataaccactgatctttttactgtctttatagtttggccttttccagaatgtcgtatagttgaaatcacagtatgtacccttttcagactggcttctttcacttagcaaaatgtctttgttttttctgtatctttttgtggcttgatagttttttccttttagcactgaataatattccactgtaggaatataccacagtttgcttatgtagtcacctattgaaggatatcttggttgcttccaagttgtggcagtcttcattaatttctttctttctttctttctttcttcttctttttttttttttttttttttttttgagacagactcttgctctgtcacccaggctggagtgaagtggcacaatctcagctcattgcaacctccgcctcccaggttcaagtgattctcttcctcagcctctggagtagctgggattacaggtgtgcaccaccacgcctggttagtcttcaggaatatttacaggactgtatagaattaggagccatcaaaggggatccctgaattctttctgtttttcttacaaataccagttttaaggtcaagatttactaccccatgcaacaatgtagccgcattttaaattttaaatttttgacagtttgtttaaaggtctcaggcaacctaaaaggctagatagaagtctctcatcctctaacgaaggatggattgtaaaatggaatactgctaagactctccctttgggtactaattctgcaaaaacctagaatctcagagacaagagacaagtatttggagtggatcattagatgtaatgacaaaaggagtcacttcaacgttcataacaaatatcaaagattgttgtattttttatatgggagacaccagacaagcttatacttagttactagttcagaggatacaccaccacatcgtctagcatgagtacaaccttataagccattgtctccagctggcactgtgattgagtctttaataaaatattcaccattctataataataataattttggttggtgataggataaatggtggaccaggtgagtccaatgaatatctactcatttgttatacaacaagttcttttaatagaaggatgtagaacaggatattatggcagtatatataaggcattcaatgtacccatggagagtggcgatcagagaaaaatgatgtcaggtaaagcaaatgtaattcaaggataaaggtagattccatttacaaaattccttgttgcctttatcatagaggagctccagtaaaatcaacaagtctgacaaaaggtgactggtttattcacccaggatatgttattgtgtgcttagccttggactttgttgcttgtgtgttggacgcctaatagtcttgacagctaaataggcttttgtaagcgagagtggtaaagtccaacatgttgctaaacctatgtgtattctctactgctaccaccaatgttgctgtttattagccttctgagcaagcaatgtagtgcctggtgaaagagattgtttcataccttcatatctatttgataaccttcctgatgatagtttggtgagcatttgtattaagcacaaatattcttacactctggctcattttctgtggttcatctacatattttttccccaaaactcattgccaccaatccttcagtgtttgtctttctgagtccctaattatcttttcttttcttttcttttttttttttttttttgagacagagtttcgctttgttgcccaggctggagtgcagtggtgcaatcttggttcactgcaacttcttcctcctggattcaagagattctcctgcctcagcctcccaagtagctaggattgcaggcacacaccaccacatctggctaatttttgtatttttagtagagacggagtttcaccatgtcagccaggctggtttcgaactcctgacctcagacaatccacctgtcctgtcctccaaaagttctgggattacaggtgtgaaccatcaggcctggccccaagtccctaattatctagacaaattattagctgccacatatacatcaataatatctctccttctagacatcgtggacaaccaattacataggctgaatttcttttaaaattgcattcacgtaggttataatgcctaagcaatctacttttggctgttgctgtgatgttgtacagtgacttctgtaaatcaggctcaatttttccctcactaatcaactggccatagagaacttcccatgaagacataggtatagattctattattcctacctgctgatgaagcaggatagttaattggaaaacacttatttcatgataagcagctcatgttgtcatatttttttgcattgataggacttcagtttctacaatggtccaggatcaatcaagagttctttaaagaaaacatttattttgtcaaagaaagaagcattttgttccaaatcctaagaacaatagtagtggtgtgtcagaggctctattgcatctggatataaaaacaaaggggcacaatattcctgaccagttgggaattattatcttgatctcaatcccatcaaaaggtggcagcatgacaagtcatgaagtaaaaggaccaggtgataaaatgaggtctccaaaatccaaagcatcaaagttctcagttagtggtcagggctgcaaagtgccataatttttcactttggaaggtatatcttgagaatattgagtgtatgagacaagttaaaaggtcatgcagccagacgcggtggctcaagcctgtaatcccagcacttagggaagctgaggtaggcggatcatgaggtcaggagttcaagaccagcctggccaatatggtgaaaccgcatctctactaaaaatacaaaaattagtggggcatcgtggtgccctcctgcagtcccagctacttgggaggctgaggcagcagaatcgcttgaaccctgaaggcgaaggttgcagtgagctgagttggcgccactgcatccagccttggcaacaccgcgagactctgtctcttaaaaaaaataaaaaaataaaaataaaaaaatttaaaagttcgtgattaacacctctgttagcctctgatctttataataattatcacacacacacaaaccaaacaccacacatagaggaaacagtaaaagattaaaggacacagctaaaaatacatttgtattattacttcccaaagttctaaaattatgagaagggactagtgaatctttaaaaaatattgattatccaacactttttaataaccagtataattgcattgaaggctactgaacatgcacatgttcctaaaatttttctgttatggtgtctggtttgcgaaaggaacaaaattaaacatagttccttggcaatttttccctcttccactctactaattggcgtatgtgcgatgtgtgtttattgtaaaataggaataagattcagaggtcaagaatcaaagtgagtcagagtaggaaaagccagactcaagcataacagaagggcagagcctgtcaaaccccaaaattaaagggtaaatttcaacacaagtagaagtggttcaaaagctaagggcatcctcatagttcatgaaaagcaagtattcacgcaggtagcagactctaatctgcttcaagccaatgtgctattctcttcgtgttatttatatccctcagaatacctcaaagttcccaagagcagtcagtatttaactctaaactatatcatctatatgatatatttattatatataatatatatattatatgtattatatattatatatttattatatgtataatatatattatatatttattatatatataatatatattatatatttattatatattatatttatatttattatatatataatatatatctgtttattattatattttttttgagacggagttttgcttttgttgcccaggctggagtgcaatggtgctatctcggctcaccacaacctctgcctcccaggttcaagtgattctcctgcctcagcgtcctgagtagctgggattacaggcatgtgccaccacgcctggttaattttgtatttttaatagagaaggggtttctccatgttagtcagtctggtattgaactcccatcctcaggtgatctgcctgcctcgacctcccaaagtgctgggattataggtgtgagccaacgtgcccagccaactatgtaatattttaattgtgtagtgataaccctcatcaaaaggagtattcattatggtcagtgtactctgcttatttaccactaaagcttaagacaaaattgttgaaataaacatgcatattgaagtacttagctagctattgaggcaatacaggtttctagatttactcatgtttttcactgtacacacatgtcatgtgtgtcatgataaacccatgtgtgtgcatatattgattaaatattatatttctttttacttttattattattattgagaaaaggtctcactctgtcgcccaggctggagtgcagtggcacaatctcggctgcctgcagccttgtcctcccaaagccctagaccctgtaacataatagaatatgtatgtttctaatttgtgcaatatggaagcaggaatactacatagaactgtcatcttttcctattgcatttattttggtgtggaaaaatataataattggcttcagtcagtaagtctatttcattcaagaatatttaaatataatccaaaccatcttagatacattttgtgatacaagaggatggtatcttctacttggaaatataaaatcccagggtctcacagtttaagtatactttccaggggtatgtataaaacaagaatcccactttacaaagttaatagaaaaaaaaatatgctaattggaaggagaggcttctgattgaggataaagtggaaattttcacatactgctaattacactttaatggagtaagaaaaaaagaattggaaatagtaccttataaaacttctgaaatgaattacagtttctctctctctctttcttttttttttttcttgagatggagttttgctcttgttgcccaggcgagagtgcaatggcgctatctcagcacactgcaaccttcacctcccgggtttaagtgattcttttgcctcagcctcccaagtagctgggattacaggcatgcaccaccatgcccgctaattttttgtatgtttagtgacccaccacgcctggctgtctcctctttttagaattaggagaactgatttttttcaatgctaaactggcactgtcctgtgttttcaagaaagcaatatggtgaaatggaagagtctggatagcatgttttgttagctggcgtctagttctttaagttccatgagtctattgtgtcttctttacatctcaaaaagaagagagaagaaacctgcatctaattactgaagcagtttcattcagcaaatgtaattgcatcgcaggcacatctcaaattaaaaatcttgatcttggtctctgtcatttccattttaaactgggactgaataacctgttttgccactcaaaataatagccagtgtctctttcttattaaaatatgtgatcttttgcttgattacctaattatgtcacctgcaccttacgtgaggcagatagaagagtcttccagtctgccagagcagatctaccaaactagactgcacatacaaattacctggggatcctgataaattacagattctgagtctgctttcaaacagggcctcaagtcaagctgatggtattagtcccaggatccctcactgagtagcaaggtcttagaattaaaaagtgtgcaagtataaggccaggagcagtggctcatgcctgtaagcccagcactttgggaggccaaggcgggtggatcacctgaggtcaggagttcgagaccagcctggccaacatggtgaaaccccgtctctactaaaaatacaaaaaattagccaggtgtggtggcacgcacctgtaatcccagctactcagaaggctgaggcagaagaattgcttgaacctgggaggtggaggtagcagtgagccaagatcatgccactacactccagcctgggctccagcctgggcaacaacagcaaaactccataaaaaaaaaagtgcaagtttataaacatggaaacgtggacaattgtaagcaatattagagaactgtagaaaacaattttttaagtgatatgtttaacctatttagaataaaacccattagggtcctaggaatttctggaactgccttacttgtgagaaacatgatcctaagatgcccatttgtttatcagtacatcaattttctccttcttaaattggtataattattttcttccaagaagcctagcacacttttgttgttgtcattgaaagagggcatataagggttatggctgctatttggagaaatgcattagaaaataaaaagcttgaaaaagttgtattactgagaaaaatgttgaatgaaaataagaaagattaaattgaaataaataatgaatcagtaaggtatgcactgttaaacacttgatgggatttcccaagtattgacatgctgataacttgaaataagaatgggagaaaaggtcaatctgaattcttaaaatgttgaaggctgggaataagaagtaatatatcacagaatctgatagaaaaatttttatttattttatgggagaaaatgggagactaacagacaataggaataggaaagaattaatagaaatagcaaaaagaagtgtatctgcaattattaatataatacaagaggaaattgtgtagagatatttaaagaaagattgatgaaatttagatttatggagaaatatcctaataaagacattatttacaatcaactgttcataattattatataattctgacagtttttaggatataaatgtaaggcagaatgatctaatataaaatgtataaatgggacaacatataattttgcttaggaaattgaataaataaagtagtgatttacgatttgcattaatataaaaaaatttaaaatggtttacatcttgtttgaaatggatgataaacaggaaaaaagtaatttagtacattgagtaatttagtacattggtcaccaaagaaatacaaattgaaactataagatgccttctcccatctttgtcagatttgtaggtataaaaacagtagtagttgtattggttggagaacagaaagatgacactttcatatgcggctgattagagcacagattggtatattatttctgagatgcaatttgaaaatatgtaccatcagcctcaaagatgattatgaccatgtgtcactactttcttggaaatcattattaatgcatgtatagattgatgtttactgtagtattacttaacataatgagttgagtacaaccttcactcccaaaaaacatgaggtaggggtgaattagttaaatatacaatcacaatgagctatgacaaaatgcagttacttaaaagcacatttataagactattaatggcaataaacatgatttgatataatgttttcaaaaattaggggaattctattcctagcattgtgacagactaaatttgctgaatcactatcctgctatatgaaatctacaaataccagataaaatgtacatgtcatttttcaaaagtatattactgacttgaatagaaattaaggtgaaccacataggccaagcataaggagaatacataaatccagagaggtatgcagacccccaaaccagaagcttccataaggacagtcctggccctagtaccctgagcttcaatttttatgaccacctgggatatgggagagtgtgagacaaaacctagtgcctgcccagtatagcagtcttacaggagaaaactgctgaaagccagagatacgaaggactataatttcagtgaaaggataaactagataaaaacctgttcctcagggggagacaaccaggaaattttcctgcctcaaactcggtgctatttagaggaaaaattagaaggccatcttcacatgaatttgtggtttaaattttcactgtaagtataattttaaaaaaacccacacatgaaactgataatttattttatagttatcccatgttggtattaccaccaaacacaagacgaaggcaaagtgtctttggagaaacccacattcagcccatgtctcaaagaatggccacaggtaaaatttcatccaaaatgagaaaaaagtaagactcttacaaaactcatgaggaaataaacatcatgagcagaaacagaattatgcccataaagatttcagatattaggatgattatataactataaaagctgtgtttaataggtttaaaaaatcaatgaggtgtgccaggaatataaattgagacagtgtatgtatcttatgttaagcagattgaaactgaacttaagagatcttttagaaataaaaaatataatgaaaattaaaaactaaatggacaggttaaacacaatattggatagaaccaaaaagaaaataagtgagttggaagttagactaaacaaattatgctgaagacagtacagaggaggaaaggaaaatggataggtgaaatagaggttgaaaaattagagtatctaatcatatctgcaaaagaaaaattgaattgggggaaggttatatttaaggttatatttaatatctgagggcttttcatcattggaatttattaatgttcaaggaaacctggaaagttttctaacacattaaaggagctttaattataagttccaaattcttcttagaagaagagaaccagcaggcccagacatttttactggtgagttctatcaaatgttttcaagaaatggattatttccattttataaaaacaactccagaataaaaaaaggtccatttgttcgttcattttatgaggccagtacaaccttgataccaatgttatatgagaaatgtgtaagacaggaaaattacatgccaactttcctcatgaacctaacggcaaacattttaaattaaaagttagcaaattaagtttagaaatctgtaaaaaagataatatagtatgaaaattgtgtttgttccatgaatgcaaggatttctaacaatagaaaaaaaactatgtataattcatcacattaacaagttaaaggaggaaaagcaaatcatcattgtagaagaggcaaaaagtgaattcaataaaataaaatatttaactttgacaaatcttgtttagcaaacaagaaatagaagagctttcagtgtttgcttataaatcagaaactattcttcgtctttcaagcagaggtgatttaatacaggtgattgattacacaagtgatggaagccaaaccaggcttggtgagtcagcagctcaagagcaagaaaccagtactgcccctaagactagaaggatcatggaagaaggtgttattatcagagccaaggggccaggacttcaggcaggttgctagagctaatgggaattgggtccatggagggaggggctatctggtgggaagcagccctgcagagaagaggcaggcttttatggcatctctcactggatagcctactgggaaaatggagggcaaaggagactgggaaataaatgttattttcctgaaacatagaacagagttggagagtaatttgggagggatctgggggcaaatttgtcaggacccaagacatgattaaagcaggcagggaaaagagatgctggtcaaagcaggtggcctttgctggtatttcaaagtcctagttttaaaactcagaggttttaaattattatcttattactaatcagatattttatacatatttaatatatttatatattaaatatttaattataattcaaaacttttatgtacactataatctcattattgttttctatactattatatacaatatacaaatacagaaatacagaaatgtacctcagtttgaaagagaatttgaatatgaggcaaaaagatacccccaaattatagttacattacaagaattgaatttaagaaggaagaagcaaattgcaagagataagaccaagcctctttagtaatgatcattctaaatccaattggtataaatttagagatgcacaactggattgcagtgtaactaagaaagtttgtgtgtcaaaaaccatagttatcctatgtgaagaaataatagtttcataggagaaggttaattggcatggagtctgtaaaagagaagtttggatagatgatcgagctatatatttgtcaaataatatctaaaggtaaaaagatctagttcacagaggcgaatctctgattttttaatttgcattaacagaaacaacattggaagggagtatattaagattttaatagtgactatttctgccaatggtttctgttttattgtttactattttcggtatatttccaatgtttcttaataagtgtttattatttaaaaaatgagaaaacagcaatgagtaattcagtaaaataaaatttttcaaaattgtgactgctatgattatgagccaattatgaaagaaagagacacagatagaaatagggtgaccaatctttcaacttactcaggaatgaaggattttctggatgggggatttttgttgctaaaatcgggacagtaggggacatattgggactgtggaaaaaccctacagggatttatttcctaactatgaatgtctatcttggtctagagacgactgttctcataaataggtagagtagatgtggtatttctggaatgagatttaacatctttacgtagcttgccctattaaaagtagacaaatgcttgtgagagaatatcatatacttttgaaagctaatgtcttaactaatttgctgcaagcaaagctcttgaagactctgatgtaacagagattcctaggtatcagtgaagatacggagatgaaaaagggaagttgaaaaaagaagctgagagataagcatggaaatcattttccaacctcatttttccagtctccattttcctgtattgagaagtgaaaatatgttttctagagataaagttctagaaatgaactctgacatagatattttaaaaccaatttcagaaacaaaataatatgtgaacctagagtagttgtaatttatgtccttttgtttgtctttatcctgtagttaagtttcccttgggatctctttgggaaaatggagtactgcattttacaaggcaggacttgaattttctttcttttccttctttctctctttcttcctttctttctttccttttcttctttcttctttctctctttttctttctttcttcctttccttccttcctttttcttttctttctttctctctttctttcttcctctctctctttttctcttctttctttctttctttctttctttgttcctttctttctttcttctttctttcttcttttccttccttccttccttccttcctcttcttcctttctttctcctttctttttattttttttgacatgatctcactttgtcacccaggctagagtgcagtgatgtgatcatagcttaatgcagcctctctctcctgggctcaagcaatcctcccacctcagcttccagagtacctggggctacagctgtgtgccaccacgcccagctaaaggacttgaattttcttacatatcttggccctatagagtggttctcaaccttggctgcacatgtctattacctgagaaaagttttaaataacctaatactcaggtcacaccctagactttaggggtgagacaagcattaatattttttaacactcttagaattaagagccactaatattgtagcactgcaattcctataaagagaacagatgtgagtcgatttgttacagtattgttgtattcatctgttttcatgctgctgataaggacatacctgagaccgggcaatttacaaaagaaagaggtttaatggacttacagttccacatgggtggggaggcctcacaatcatggtggaggacaaagaggagcaagtcacatcttacatggatagcagcaggcaaagagacagcttgtgcagggaaactcccattttaaaaatgatcagatctcatgagacttactcactaacacaagaacagcacaggaaagacccatcctcatgattcagttatctcccactgggcacctcccacaacatgtgggaattatgggagctacaagatgagattgggtgtggacacagccaaaccatatcaattgtcatcactcaaggcagatgagtatatagaaagctatcagttgtaaggaattggactaagtttaagagaataataattaagatagaacaaatgtttggtcctgcttaagggctaggatagatgaggcacaatagaatcatgtggggagctgtaaaaatgcccaggccctactctgtgtcaattaaatcagaatccagaatctctgcttgagtgtgtctagagtattggtcaaaggaaacagtgattttgatgtgcagccagttaagagctgatatcctcaaggatcatgatgtgacacagctgtttcagaagggtaaatctccatactcccactttagaagaaaagaaaaggcaaaatgacaaaacaatcaagcaaaagggctggaagagctggtagataacagggtgtcaacttgaattaattcagctctttggtaaagattagctggagtaaagaaattccagttagtcaaatgggatgaatgtccttttatggaaaccatatcatgctttttgaatgatctgagaaagactggaagcattagaggtgaagtatatccatttgctcaatgggagaagattttgttttattttatttacataatgtgatatgcttggccatctgcagtagtgcctgaaaggggatgtaaaacggaaaatgtagtcaatgagactgattaataaccctgggtagaaaaataggccaagtggaaaaacttattcatataattgcttcattttgctgactgcaaaaggatttgttttggaagtgatttctgctctttaacctagtggattgatagatcacagaaaggtcttagaaatgacattacgtaattttgttcataacatgaaattagcttgaatcaaaaaatgtatactttttttgtatctaccttctaagacatttgtcttgagaaattaatgattctacaacataaatagtcattgtgaaaggaaggaaaaagataacagagggctttcataataatcatggactcaagattatctaatttaaaaagacatatctcattttcctttatttaaacataaaacaaatgagagaaaacagaaatagctcataattttatttatctgataaaacatgctgacataaaaatataattcatgcacccagtaagaaaatcaaaaaattaaataaaggtaaaaatgaaatataaaattctctttcctctagtctcttacccccagacatctagaatctctccttaagataatcactgttgacaatttcttgagtatctttttaaaaatgaccttaatacacatcccccgtatagaatatagatcttaaacaagttagaaaataaaattttatcttttagtattacacaaaaggatgttcagaactaggctttgtattttttttttctagagataaggtctcactgtgttgcccaggttggtctcaaactcctgggctcaagcaatcctcccgcctcagtctccaaaagtgttgggattacaagcatgagatgaagtcttgcctggcctaggctttctatttttgtttaataatttaccttcaagatattcttaacttttaacaactgtattgtataaatatattttttatttaaacaataggctaccaataacattaataacatatcttggtttatgtattttacaagattctccatgtgataaattccaacctgagaagttgctatagaacatatgaatttaacattttttaattgctgcgatctaatatgatcctaaaacatggccctagtttatattcctatgagaatgtctaatacctacactcttgctaacattgactgctattgcattttaaagactaatttgattggattgatgttgaacatcttctgttactcctggccattgcatttctttttctacctattaatctcccttgtataatattgcattattcgtcttttttgtctcatttatcgacaaagattaaagttattggcagtagtgaaaatggagaaaaaaatcaaaattcaaatactgtagagtacaatattttggagaataatttgattctatatattgaaatttaaattgtctttaatctttgacccagttattctatttctagtaatttttctacccaaataataatacaggaaaaaaacctttacagagattattcttataatgtttgtgatacaatatttacaggcaacataaattctcatccagagatcagagtaaatattatatagtatatctgtagaatgaaatgtaccttgctgtttaaatgaataaattagttattatcataaaataaatgtcatgtaaagacatttattttatggtgtataaaattagaaaaacaagttattaaaaataacatgattttttgtaaaatgcttttattttgtttttaattgacataataattgcacatgtttatggggtacagtgtggtgctttagtgcatgtgtacattgcgtaatggtcaaatttaaaaattaaatgtattgatagaaaaagtgtttggatatttgtatcctaaatgctaacagtgatgatatctggaatgtggaactgctggtaatttttccctttttcttttagagatttttgtacttatttttaataataaacatatactaattttataataaaaataacaatgaagtcctttccattttgaaaaattaattccaatagaaaaatattgtacttgagccactttccagggttttcttattcttagtgctggtataaggtaccagtgatattatattttcagatatgtttggcttttctgccttatggttgaagatgagcttaggaagtattgctgcctaattttcaggcttttgagccaatgcttggtgcacaaaaagcaccacatcaactttaaacagaatattctgcttctttagactgtatttcctactttttatagtatttattagcgccagaactctgtgactgtttcccaaagaacaagagagaaagatcaaggaaagtgagaagcaatgaaactagatttaattaatactctggcttgtcagcagccagatttgtttgttgaagaagttgaacctattagcttaaacagggattaactctgccaactctgacagagcatggacaattaagagtttattggaaattaattgaaaataatacagtgttgtgaggtgggatgaagatgatttcctttaaggaaattatgccaagtgttttgaatcagccaaggataaacaaatgcagactatcatttgatggaggtattataaactgataacatgattcaaagtataagaatggcaaattgtgaagaatgaatgaaattacagagataaatagcaaaaatgtgaaactaaaataaagaggaacagtgagtaaatggggttagctgagaatatggtttaacagggcatactctattcatttatgaagaaattttaatcctcaaaatgctacttgtcttagtctgtgtaggctgctgtaacaaaataccacaagctgagtaacttataaacaacagaaatttcttacagttgtgcaggctgggaagtccaatatcaaggcagattcagcatctggggtgaggttcacccttctggctcatagatggcaacttcctgctgtatccccatactttggaaggggccaatgagctctctgggatctcttttataagggcacaaatcccattcatgagaatcttgtcctcatgacctaatcacctccccaaggctctatctcctaacacgagtagcttgggggttaggatttcaatatacaaatttggggggacataaacagtcagtctgtgacattgccatttcgtcagtaagaattttcatgaactcactattaagatttatgtttaggttttttatgtggatgttctcactttataatattgtttgtctgcatagtttaaagaaaaggacaatgcccaattagaacaggaggtgtcttttgttggccagcaaaatattttaagatgccttgagtgtgaccctacatagagatcattaaggtaacatcattttgttcttgttatagatccacatgtttcactcaagatcccagaaagaaaatgtatgaaaacacattggaagacaataatccatccttacaatgttagccaatgtttattattgctttctatgtgtgaggaattgtgttaaacacttaaaaagatgttatctctcataattatcataacacctgaagaagtaggtggggtgattttctccaatttagatattataggaactgaaacacttgcccactaaacaggcaattgaaagagataggatttctatagaaaattgccagctccacagctagtgttcctattctcatcattagtgttcccttagtggttttgatattacacctaatactatttaatacaaaattaaagcacccaccctattctgggatttactgtcaagaatagagcactgagcctgataaacagtatccactttggaatgcatgtttctatccagctacttaatatgacataagttcattggacattaaggccagatttcttgacatgctttaccctcaaattaacaagtttggcttattcaattgtggacctttaacccttaggccagatagtatatgaggcctagagtagtggaaaaaggtaactggatttacaaaatttgactcttcaaattctgtaagaattcaatatattgaggaaagtttaggtgcatagtaaaattataatttcatattgttgcacagactcaggcagatgaaagagactccaatagtggtcaggtagtacccagacagtcagttgattgtctctgtgctgaaaggatttaagaatgaagaagagtttgctccaatgtatgtttcaatatctcattgttttacaataatatttgaaataatacctaggaacccaacttacaagggatgtgaaggacctattcaaagagaactacaaaccactgctcaaggaaataaaagaggacacaaacaaatggaagaacattccatgctcatggataggaagaatcaatatcgtgaaaatggccatactgcccaaggtaatttatagattcaatgccatccccatcaagctaccaatgactttctttacagaattggaaaaaaactactttaaagttcatacggaaacaaaaaagagcccgcattgccaagtcaatcctaagcgaaaagaacaaagctggaggcatcacgctacctgacttcaaactagactacgaggctacagtaaccaaaacagcatggtacttgtaccaaaacagagatatagaccaatggaacagaacagagccctcagaaataacaccacacatctacaaccatctgatctttgacaaacctgacaaaagcaagaaatggggaaaggattccctatttaataaatggtgctgggaaaactggctagccatatgtagagagctgaaactgggtcccttccttacaccttttacaaaaattaattcaagatggattaaagacttacatgttagacctaaaaccataaaaaccctagaagaaaacctaggcaataccattcaggacacaggcatggcaaggacttcatgtctaaaacactgaaagcaatggcaataaaagccaaaattgacaaatgggatctaattaaactaaagagctcctacacagcaaaagaaactgccatcagagtgaacaggcagcctacagaatgggagaacatttttgcaatctactcatctgacaaagggctaatatccagaatctacaatgaactcaaacaaatttacaagaaaaaacaaacaaccccaacaacaagtgggagaagtatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttcacactgttggtgggactgtaaactggttaaatcattgtggaagacagtgtggtgattcctcaaggatctagaactagaaataccatttgacctagccatcccattactgggtatatacccaaaggattataaatcatgctgctataaagacacacgcacacgtatgtttattgcggcactattcacaatagcaaagacttggaaccaacccaaatgtccatcagtgatagactggattaagaaaatgtggcacatatacaccatggaatactatgcagccataaaaaaggatgagttcatgtcctttgtagggacatggatgaagctggaaaccatcattctcggcaaactatcacaaggacaaaaaaccaaacaccgcatgttctcactcacaggtgggaattgaacaatgagaacacatggatacaggaaagggaacatcacacactgtggcctgctctgtggtggggggctggggggagggatagcattaggagatatacctaatgtaaaagatgagttaatgggtgcagcacaccaacatggcacatgtatacatatgtaacaaacctgcacgttgtgcacatgtaccctagaacttaaagtataataaaaaaaaattaaaatattctgcagtcacagtgactgtcttggcttctcttaatttatgaggacctttgtcttatagactcttttttaaaaaaaaagatggggtcttgctatgttgtccatgctggagtgcagtggctattcacaggcttgatcattgcatactacagtctggaactcctggactcaagtctcccagtggctgggaatacaggtgagtgcctaccacacctagcctgatttacagatttttgacatctattatagttaaatgtattttcagcatttgcatattaaaggaataatattgatgcttaacttcattagtgatcagggaattccaaattttaaaaaatttttttcatctcttacagtatatttaaaaattcattgctgataaggattcagggacgccaacattgtacattggtagtgaaaatgtaaattggaaactttctgtaatctgacagtaattatttttttaaaaatccttttgaacttgcagttctacttttgggatttgaatttatggaaagtaaagtgccagtgagaaagaatattgttgccccttgaacaacatagggttaggggagctggcctcccacacagtgaaaaatccacatacaacttttgattccccccaaactactaataacctattgttgaccagaaggcttactgataacatgcgttacatttaagacatattttgcatgctatgtgtattatatactgtattcttacaataaactaagctacagaaaagaaattataatcaagaaaattgtaaggaagagaaaatatatgacccattcgttaagtggaagtggatcatcctaaaggtcttcatcattgttgtcttcatgttgagtaggcagaggaggaggaggaggagctggtctttgtgtcttagggtagcagaggtggaagagggtgaagggatggaaggggaagcaaaagaggcaagcacacttggtgaaactttacaaaaatacatcattatttctgtctattttgctttttcatttctctaaaaacatttcagtgtagtacctatcagtcttccaccatttgctttagtttcagttcctgtatcattgaacggtctatgtcataaaagaagtcaaaagtagtcttgaataatcaaagctcttttgccagattgttgaatgccaatttgttttctggcactgcttttcctatgtcttcttcctcattatctggcactggttaggaagcactcatctccatgaagtcatcttttgttaattcctctggtgtggtgtgtattagctcttaaattcctccaagatccatatcttgcaacccttcactccacacctttttttcccttcatatccatacttctttccatggttttctctaaattgggtttgtcgtaattctgtagctatgcacaacatctggacacaaattgtacttttgtccagcaggaatttattgttttgagtttcatggttttctatatcaactgatgacatcttgaaaggtgtaagccttccagacttccatgatgttctctgtattgggtttctcttttgcaatgttgacaaacctttccatagagtgccatatgtagagccttaaaggtccttatgactcccttatctagaggctgaagtagagatgtgtttgggggaaaaggagaacacttcagtgcctttggtgttgaactcatggggttctgggtggccagggggcattttccaattaaacaacaacaacaaaaaactttaaaaagcagtcccttactggcaaggtacttctgacttcagggacaaagcactgatggaactaatccagaaaaagcattctcatagtccaggccttcttgttgtacaaccaaaagactggcaactagtgtttctcttttccctttcaagactcaggggttagcagctttatagttaagggcagccctgatcataaacccgactacatttgcacaaagcagtagagttagcctatcccttcctgccttaaatcttggtgcttgcttctcttccttagtaataaatgacctttgtggcttttatttttccccctggaatagggcactttcagctgcattaatacctattcaggcagatatcctttctcctcaatgtttttcttaacggcatttgagaattcacttgctggttcttggttggcagaagttgctactcccattatcctgacatttttaaaaccaaaccactttctaaaattatcaaatcatcctttgctgccattaaattctccagctttagatctttcaccttgcttttactttaagttgtcaaataatgacttcgctatttcttgaatcaaataagagtctataggtatgtctttcttatagcaattctgtaccccacataaaagctgcattttgaatatgagataagaaaggacaaggttttcatgcctgttggcacgaaatgaggccttatgaatttctcttttttttttttaagggaccttacactggattcatttattttgaaatggcaggcagctgaagaactcaatctataggaagcaatctaactttttctcataatgtcacaacttttctctgcttcttgggagcactcccagcatcacttgtggcactttgtattggtctcatggtgttattcaagatttatagtattacactaagcacaatgaaaagagaactgtgaaagaacacactatttacttagatacagaatttactgaagagaccaagtgctcatggcagatactggcaacatgagctcaccacagtagcaacagggggtggctacaaaattattataatagtacatacactggaaagtagacgctggagaatattccaaaagatgccagggttggaggggagtgagggttgaaaaattattattgggtacaatgttcactattggggtgatgagtacagtaaaagctcagacttcaccactagcaatatatccaaataacaaaacaatcatataataaaagtatgcttgtacctagcacatttataaaaataaaataaaagtaattatttgggtagtacagtatgtgctatagttaattgtatgcagttgtggtttaatacagcatctttatgtttgtttatgtttctcttgactgcaaatagtgacttgtacggtttgtgtgcatacattttgataagttttaactttttataatagatttgtgtatattttatggtagtaaatgataaaatagattaacatatacatatactttatgcattcaggatgtacatagctttttcttaatttttttcttatattctaggctatgcagttagtctgctagttttttcaattgcaattctccaaaactttttctgatatatttatttttttaaaaaaataccagtgtaggcggacctgcacagttgaaacccatgttgttccaaggtcaactaaaaaatctgaaatctgaaatgcttcaaaattggaaacattttgagcactgatatgatgccacaggtgaaaaatttcacatatgacattatatgactggtcacagccaaaagacagtcaaaattttgtttcttgcacaaaattttacaaatacataaaattaccttcaggctacatgtatactatatgtagggaatgtaaataaatttagattgggtctcattcttaacatatcatgttatgatatgaaaatatttcaaaatttgaaaaaatccaaaatctacaatatttttggtcccaagcatttcatataagggataccatactccagaatgttagaatgtttatggctactttgtttgtagtacagggggaaaaaaatcatgatgagtctccatcagtaaaaagatagtttaaaaacttgtagaatttagtcatatacatatatttacacatgcatatatgcacacatattatttttctctatatagagaaactgtgcattcatttaaagtgatatttcctctttttgttaattgagttggagaaatgttcatactgtattgataagttggaaaatcagtttgtttacatgaggtgaagtggaaaagttaaactacattataaagtacattataggcttttcaaaggacaaaaaagtgtcacctgagatgaggcaatgaagtgctcatggccattcatccctattttacaccaatagaaagaaaagtttggaaaatgttggatttctcaataaaatttcaaggaagtagagataaatatgttactgtactaatgtattcatgtcttcttaagagaaatggaactccaaatttttagaatttttgaataggaatgatagaggaaagaaaacagaacactagtgactccggcattgtctgaagctgaggactgggctgtgggtaacccacaggtgatattactttagcctgaataatccagacgttatgatgttttggcctctgtgtccaagactcttgtagatttcttgtcaggccacaattctttgagtgagagtaatattttttcagtaggcaaaaatcccttgaaagatcaatccagggacatttataataaagataggattagaaggtagactttaggctagggttagggttggaaaaatcaaaacacgttgttctctttagagtgagaaattggtttatcccagactttgaaagataatataatctataaccctctggttacgggaaagaagagacctacatgtggccatcttgggagcaaggcagagagcaggctggaagatcttctaggatggatatggacttgtgaaatgcagtagttaaacaaagttttctcagagttacatttgccttccatcattcctgaacactcatgtcatcatgaaattagaagagctgatccaatactattgataaggaaagagactctcctttccccaaagcgagagatagcagcaataatcagataatggcccagaagatggatgatcatacacacggcttgtgtgaggcttatggaagataaaacaaccacaatatttcagaaatgtttatatgttgtttacagttctaccactacaaagccttctagaatgtgagacagaatggtgtgatgattattcttagtataaccagattaagtaagatttcacaggtggagttaagaattaagaatttttgattcaagagtctcattcaccctcttccttctttgttaatagttctgttaggatctgcctttaatttgtcttttcctttagggcgctcaaaacaacacaaggattaaatgcctttctatggtcaaagttctctccttatttgccagttctttttttcatgtcccaatcataatcttaatggtatcgttgatcactcaagcaactaaccctgaagactgcccagtcacaggagccaatacatctttttatgtttaaactcaatcacttcaaatgttgatcttaccttgcataatagaaattagtcgtagagactgtggtgggatgagatagcattgcgggtaatctggctcagctatggctgagtggaagaaacttgcatcaattatttatggttaatacagagtatcctagatcgtagttgtggactgaatacagacattcagctccctcccccactgagctctcataacaatgcagggactggaaagaatgtcagcatatgggatgggagaatgagaagacgggagcttcttgggcagatattacgtagtgaggaagcagtgggtgagaacattcagtgagagaccacaatgtaaggagaaagtctatctgaccagtggaagcagagactccagactcagaacctttggtacgaagagtaactacagcaaacgggcaaagaatagattgtgaatttggaggttatgtgcttccttctggcacatgaaaaaactcctaaagctttttgtgggtccaaaatgaaataaaaatctttccccattggtatgaaaataagttaattagcttttacaatggtttgtttttgtgttactagtttccagttgtggctgtttctctcagtttctctctgttttggtttgtttgtttgttgttgttttccttctcttaggaaactttggcagataattgggcacagaaattggtcattttttaaacactctaggttagtgattctcatagtccctagacatcggtatcagtattacccggcaacttgttagatatgcaaattctcaaatcttacctactgagtcatatactgccaagtgagccaaggaatccgtttaattaggctttgcaggtggttctgatgcacactcaagttgaaccactgctgaagccataactattggagacaatcttgcatagcttgaaaaatggagagctctaactgttggtagggctttgctttatttgtcttaagaaagcattaatgagaatagctttgtgtttctttgaagttctgggtgcttctgaaaactctaaaggttttcaagcatttaaatttctctagcccttttctcaaacaaacaaaaaaccccaaacaaggaaaatctcatagaaatataaaaatgagttaaaataagttgtgaggaatattctatacatcaacagtaaagtattactcaacctcaaaaattacgtctctaccataatctataatctgactggataaggactataaataaatagcatatgaaagtctacaataaagcagggagaaaatcatcactggctccgaatttgataatgacttcttgttgtatgtatgtaaatatcttctgaacaaattattgtacattttcctatctctggagaaaattaatgaattaggttaaacaatttcttaagtttaatggagcttctgttttccttggcttatgtatactagcacaggtaacttgctgaactgcagctcagaagaaaaaatctatagagaggtttagttctgaggtgaattaatggactttgttgctatgtcagaaggcgagaagcaagggaaggcaggcgggtaagagaatcacataacgcaaaggacttcagtgcttcagaacaaaattgaagcgtttcaaaaatttgactgaagtaaagttcagtaatatttttaatcatgggaaatccttggataaatgtatatggtttgataattttggtttaaattaattatgttttttctctgattttatcacaatcttagaattaatgttagcatatttttctggtttataaaatattttaacttaccagagctttctagatgtcccctactcgatttaaggctcagctgaattgaattattaaactagtattttttaaaacatttgttcctgtaacttgagatggggctacaaataattatactgtataggtaaaaccacacataccctacctggtaaaaaattcaaatttcatatgtaacacaattttcatgtaaatttttatattttagtataaattctctgcagtgtgtcagtttaaaatgaattttaacatactagttagctttatgagcttggctaatatttcattgagataattagtgaaaaatctttggataagtctcataaaatttttaacatatccttgctgcatatttttacacattatagagtggctatcaagtaggagaatgaacagtatgtaaaagtacccttagttctgattaatgcacatgttcttttatactactttaagaaattaagtcagtttgagtatttagaaaagtgcatgcaatataattaatgtgtttttgcttatcaaggcaaagagagtaattttgtctaaaaggcaaattgtagagttttgctagaatataaaactgaattttaaaatacaaatttaagggcatacaataattgtagaatatctgagggaagtaaacttcatttgctatagcttataatagctgcaaataatgagtttaaatgagcaataaaacgtttataatttttggactaactttactcaatgttaattagtttgggcataaaacataaaagaacttttgagtcttttagtcaatttgttaaatggatggtctcaaaaaagtcatattagtatttgggttacctttttgataaaataataaatcaatctccatatattagccttttttttttttttgagacaaaggcttgctcttgtccctcaggctggagtgcaatggcgccatcttggctcactgcagcctctgcctcccgggttccagtgattctcctgcctcagcctcctgagtagctgggattacaggcgcctgccaccatgcctggctaatttttgtatttttagtagaaatgggatttcaccatgttggccaggctggtctcgaacccctgacctcaggtgatccaccctcctcggcctcccgaagtgttgggattacaggcgtgagccaccactcccggccatatattagttttttagcaaaaatttaacacttgtattctccacagtgtcctaccggattagatatagctctcctggactaaattgtttctcacccacagcaatattgccatccgggagaaaagagatttatagtagtttactttgtactcctagaaatcctttcaagaagtataaaagtgaatacatacatatttaaatgataaacatttatctttgtgataaaatagttaagtttccatgtgagtcaggtttaccacatgagtgatgaaccagctttaattaacaatataaccattctcctctgtcactgtaggctgttctaaaaaaagaaaaaagtttacaaaagccttaattaccttatgctatttggggagaattaagcaatgaatggagtgttgcatttaacaggttatagaaaatttttctgtgtccagcatataatcaactactaattttcagactggtttggcacaatatagattttctgccactgaatagaaactaaaaaatttgaaagtcagaaaattatttcccaggttctgaaagatatcaacaaagatatttttaattgactatgtatgattattgatttgagatttaatataccatgtctatgagaattctttgtaatacttctgcagtgtaatttgctacataatgaaaattcatttttcataataaatagttttcagaagtcatgttatctttcttgctcccagcaagtagctctatttcttggccacattgaggaatcaaaatctaatgtaattcttctaaatagaatagagaacacctagagtcgctgctcctatgacaaatctttggataacaactctcatgtgcgtaagacattttctgatctcttctgtacttcaacttgtaaagaactttggacattacagtcagaaagtctgctattcctacaaagacaaaaggggaagcctctaaattccctgagtagtggggataattagctttcatactcatctgctgacccctgattatcagaagacatttttatctctttggcatgccccatcacctgctgtctgtctccaaaagacctgtagatcagagcaggcattgtaaggcagggacagttcctgaaatttccaattaactgatgatgggaaagctcagaaacacaaactctggggagtggctgcctggtactgctaatactcctgctggaaacaggggcacctgggctacaaacaaacgtaagactttggaagaaggtgcgttaacttaattctgcctttcacatgtgagctcccaatttcccttgtggctatgagccacaagggcccaaattcaatgggagggtggttcgggtctatcatgacaagccaggatggaggagacagaggtcagttattgggagcccagattcttgccctttagaaacatgtgctgtagcagagaggaacccactacagctgggatcctggactgacacagcgagtgggtagtccatccagggtcacctgattgatagcaggcccttcacatctgcagcccccacctgtgacactgtttttgataccatattccccaaatttaaccctcaaatccaaaatagtaaaactactgagatgttacttatgaatacagtatctctgggtttctcagatggctgctgggaaactccagagatcctcctcctagctcttaacatgaagatatattagaaataaaggtaatgttttgcattctccagatatttaattggctcaaaactatgctcaatatagtggaagctgctgtgtttttcaaggccatattctgagaaaatagcaataaaatcatcttaaattaattaaatgcaataattatgtatgattactgtggctatgttacaataattgtgcacttctcaggttggattcaggcatatttatgttcatgtacaaagactggtgcaataaatgtcaaccaactgattaaaaaaagtaaacttctcagttggtgacaaataataatatctactttgtggggaaaattaaaggccctggagaggtatcgggatgcactaattgttcttcatgtgttctgtcttttacggtaatcactgattaaaatttcattagatgagtatgtattacacctcaacagagaatgccactgtcccccattgtgatgtcgtttgctatggcaaaaaattaaccaaactttacagttttattattagcaacatctcctccccctatccccgctgcttttttttttttttttttagatggaatctcgctctgttgcccaggctggagtgcagtggtatgacctcagctcactgcaaactctacctctcgggttcaagctgtcctcctacctcagcctcccgagtagctatattcaggtgcccgccaccatgcatggctaatttttctattttcagtagacacagggtttcaccatgttggccaggctggtctcaaactccggacctcaagtgatctgcctgcctcagcctcctaaagtgttgggattacagacatgagccactgtgcccagccctcctttccctttaagcatacctaaaagcctctctacaaagcgccaatcagaatttgagtcatctggaagaaatatcaaaagagctccagtaataacggtagcagacactgttgatactattgataccacaggaaattgactcatggatataggcctccaagaataggctgaccttgtccccacagacaatattccaactatacgaagtaaatgagtcaggagttccaagacactcacaatgtagaagcggatgaattcatgaaagtagactgcttaactcaagaccagcacgacaagaggttgttatttaggattaaagggcctcagtaaggcaatttaattgaggttagtttaattttctactttaatgaacatgagaacaacccattttctttcttcttaatctacctttaatctccaattaaatttacaaattattaaatttgtaaaaactaaataaaacactctgaattcttagtgttgagggaaaaaataccttgcagaaattcttaatataaaaacaaagctaataagttgccaagaaaaacatacaaataattattttgtaaagaattgtgacatacaatatttggttttgtctattaacatacccttaattagcaatattggttaaatcttgcacaaagtttctttaataaaaacatttactttttgtgactatgtagttatttatattggttcaataagaatttgtcctcccttctacctgaatatattactaattagaaatttttttttttttttgagatggagtcttgctctgttgcccaggctggagtgcaatggcgtgatctcaactcactgcaacctctcaatcttgggctcaagcacttctcccacctcagcctcccaggtagctgggattacaggcacccaccatcatgctaggctactatttgtatttttatagagacggggtttcaccatgttggcctggctggtcttaaactcctgacctcaggtgatctgccggcctcagcctttcaaaatgctggggttacaggcatgagccaccttgcccagccaggaagaatcaattttttaataaaaaatttatatctgtgctacaaattcaatttaactagacaagacaaatccagtaataagaataatttctatgtttttcacgcagaagcgatgcctataacatccttctaggaaaccaatctggtgcttgctctatggactatgcaatctcaggcttggaggtaagaaagaatgtcctttcttggcagagcagggacaccgagacattggatatcttttattaaaaaggatacatttgcattataaatactgcagatgaaatcaggtagaggtgaacggactggtttggtctgctctaaactgagctgttaaacatgtaaaagtaaatttaaaccacaagggctttataaatctatagatagacgtaaacttgtgagccttagtttattgtttcatcaaaaaaatactaggaggtcattaaatattaatcaacacttcttagatctgtgcaaataaaatggatcaaattaaaatgtaaaatcaatagtactgattaggaacattgttcagcaaatggaggtagacaaacatgtcctgtagagaaggaaacatgaccgcaagatgaagtgtaaaaaccaaagtgacatcggggcctgacaccattgtcagcccattcatcatgtcccactgctgaagaaacagagaaaaaaaaactctgcactctgacataaagaaacaataaaagggtctctctgtctacctgcagtcctccaaatgaataaaaccttgagcatttcctgagagttgctaactccttaatgaaaatcactttatccttgactttacaatgctgtttattgtctgaagatatgtcatgaactttctgaatataataaccatgataaaattgctgttttctgccatgaagagattaatataaaccctatagtcttcataatattgtttgtcttaaaaagttctatttttttaattttttgggcagttcttttgaagaatgacttcctcacatttctttgcaagtaaatgcctccttctgcttatttttccaacatgcttttgtttctgagcctttctttcatgctctatacacacaaatcagcaggagatagtacctgcagctgtatttggagtttactgcctcaatgttcactttcaatgaaagagcgtatttcttaacagaagaccagaaattcatgctgaaccaataaattgtcctctatagttctcatctgcaaggaggatttaaatatttctagctcagtagttcagccctgaagattatttcacccccactgctaatcccgacctaatctgtttttgtgttgttaatgctcctatatactagccaggtcagtaattctgtaacaggcttaatttcttaatattttaggccatgtgttaattttactatttcttagccattttttcctcaatagttttaaattgcatccctgcttactctcccttttactggacgggcttcctctgtttactaatacaattccccaaattgattcatccacttgttgaaatacctaattttaggccctgcactgacagcttgcctaggcttatacttgtgtttggtgttgcagtcttcagattctaaaaacaccatctagaccttacattacctccagccagggctattcccccagggcctgccttaagaagcagatttcttttcaagtttcatcttcttcccatttatttcatttcatgacagttagagaagctgtatactaacgtgacaaatggtaagttagcagagaaaaacgttatttcaggataagttcagggaaagctttttggaggaaagtcagctcacattagtcctgatgatggatagtgtatagagactacagatgatggaacgatgaagtggaaactcgagtggctacatacggacattccacatagaagcagtgtgagcaaaaccaccaagacaggaaatgagatggaattgataaggcaatgcaaataattcaggttatttagatcatcagtgttgggggaagctgggtttatgggaatcaatggttaatcagaatgtgagcaccattggtttggtaattcatggaagaggttatcattcaacagggggaggggcttctcgattataaacatgtctgaaggtcactgaacatcaaggctatccttcagttaaaatcttattaaaattatactgacctctgatgaccttcagagagctccagctagatggattgatgataagagaaattcgagaaggcaatggggcaaatctttgtgcaaatctctgttatgtcatatatctaaggcttctgctggatccagtgatttgtttgttctgactgtagtacaaatctattggaacaataaatctagttataataaatgacagagggcattgaagcagatgcaagaagcaaaatatacaggtgtaaagacaaactatattaggcctcccatcaagcttctctaatattttcacagcacagccctgcctgacttctctctatctggataggccccttctgtttgataaccagttctctgatgttgactacctgattctctagtcctcaagttgactcatcctgtttattgagagtgacatttttagactactaataatatttatatgtaagaaagaaactgggtttttatataaatatataatcttttcaaataaaagattataatcaaggaactgtaaataatagaaaaattacataacgtttccctatttggggattggttaaatgcaatattatagaagtctgaaaaaataatgacggtattacaaaagaatataaaaataattgaagactaggaattatgtctaccaactaattcagtcatttggctgtttattctcatttgaacagtagtggattaagaaaaaaacaaaaagactttcgacttccatcacagggagaaaaggatcaagtacacattagagaaagctgatggaaatgatttctagtttcagtttctattttctgtcaattaaccatcattttggtaaacagcctttttaaatgtcttttcttttaatttttaaatttttactttaaagacagggtctcactatgttgcgaaggcattggcctcaaactcatggactcaagtgatcttcctgccatagcctccctaggtgcatatcaccatacccagctattaatgtctttataaaagcatttttaaccctactggtctagctattgcatcaaataaatagctaattccattgaggaaggattagggactcacgagtgaaaataaatgttttatttggataatggctacaaaatctcaacagtcaaaataaataagagattaaaggcatgatgatgacttaaaagataaagttaggtagaaatgtgaactaagggaaatgactcaacacattcagcaacacaaaactgtggcctaaattcactctgacagttgttatgctatctcctgctgcccgagtaaagtaagttatgaacaagacacatgaaggggatcaggcagacatatggtcaaatgctttctgtgcaatatgtctgtctccatattatcttctctctcattgcactttggacatttttattcttcctgcagatctatttttatgaagcaatgtgatttaaattaaaagagcactgaattctcagccagatatttgagttctagttgaagatttatcacctagtggttatgagatttggggcaaattacttaatctctctctttctttaccacttcatttgtaagttttcttgcctccctacaggactgtattggggatcaatcaatgttgagttgaaggctacatggtttaagttggcttaatggagaagtggtaaatcacttaaacgggtagaacaacacagtgtagaggatgttgggctgcatgaggaagtgtggaaaaaaagcatgccatgaaaatatcatcacaatctcacatttcttcatttatttgcacactctgaacacatgcatgtgataaggactgtgcaaggttctcaggatacccaggtaaaaatcaccacttctgccagtcttgactttgcaagcttgaggagcaggcctggagaaatttggctattaccacaccaaagttgttcctcacattccctttgacatatggtctcaggaaaaaatgaaaagagtaaaaaaagaaaaaaagtccttcatttttgaaaggaaaagtcataattaatttctagaaggagaaagaaaaaaagagataacagtgtgtgaaaaggcttagaaaatgctagagcactacagaaagataatgtgagattatgtctaagagtagcttggttattttgcttttgttgacaaagtatacctccttcattttcatagttgtcataattctttccatgattttcttagtgggtttgtttaggagaaactgtattctttctttattcatctaactctccttaactccaaaagatgcttcttaggataacattttaaaaggatatacattatgcacatttttaatgcttctatacaggactgaaggccaatattaccatgataataaggcatgtaacaaaaatttgttctgcagagagtgagaaagcgtgagggaaaacacagtgcaggattctatgctgttgcccaagaacccagacaggcaagtgaaataatagagcagacatttcctgaggctgtggtcgatatgattaggagatagtgggtaaaaatggcctttaaactatatacacatgagaagatagatgtgaaagcccattgcaaaggcaataaaattatgcaaatataaaatatcactattaaaatgtatgatgaattgacatgccatgaaaacagttccagtgctgggccagaaatcaggaaacatgggcttttgatttctcaccattaaaatgaagaagttggatttatacccaagggtaccttgtgggctgtatggcttctaagtaactggtcataacaaaagggacacaatcaggtcagtttcaaaccaagaataaaatgggaaattaaagaactgaattggctactttctgctcaaatgattgttaaaaataaagtttaaaaaaagccccaaggactatgcagtgcagtgagcagaggcccccgatattaaaaagaaaacaaggaaaatggattcctggtgatagaagtggtgtgggggaagacaaatagtgtggctgcaaatggaacaatatgcaaaagaaaagtagctaaatatagctcttttttgggaaagagattgtgtctaagtccatcagtggaaaggcaacttaattgttgtataagtctgttcaggttgccataacaagataccatacaccaagtggcttaaactatagaaatgtatttctcacacttctggaagttgggaagtccaagataaaggtggtagcaaagcggatttctttctaaggtctcttcctatggcctgtaagtggctgtagattcactgtgtgcccatgtgaccatttcttcgtgcaccagggggaaggcggacaagcaagctttctagtgtctctcttcttgtaatggcattaatctcagcatgaggacaccactctcataacctcttttaatcctgattacctctcaaaggccccagctgcataaatcatcacagtaggtgttagggcttcaacatttaagtgcgggagttggtgttcacatttcagtcaattgaggtgacaattgaaatgtgaaaggaaaaccatagttactagagagaacggttgtcttggggaggatcactggacaggactacggtcctgtccaggttgttatggcaacctgaacagacttatacaacaatccagtcctagaggcaatacaacttctctgctgattccagattctgagcgcctctcagtccttggttgggttgttttgatcctgtccatattatatttataaatattctcttcataaaactctctttaggccgggcgcggtggctcacgcctgtaatcccagcactttgggaggtcaagagatcgagaccatcctggccaacgtgatgaaacccgctctctactaaaaatacaaaaaattagccgggtgtggtagcgggcgcctgtagtcccagctactcgggaggctgaggcaggagaatggcatgaacccgggaggcggagcttgcagtgagccgagatggcaccactgcactccagcctgggcagcagagcgagactccatctcaaaaaaaaaaaaacaaaaaaaaaaacacaactctctttaaatcacacatccgagtgtgtcccttgtttcccaccagagccaagactgaattgagatgatttcttaaggtcaggttgatgtcctaatccagttgtgctgctataacaaaataccacagagtgagtaacttataaacaacaaaaatttattgctcacagttatggaggatggtcagtccaagatcaagttgccagcaggttcagtgtctagtgaaggcccattcctctgtcatccaggctgaagtgcagtgttgcaagcttgggtcactgcaaccttcacctcccaggctcaagtaatcctcccacctcagcctcctgagtagctgggaccacaggtgctcaccaccatgcctggctaattttttttttttttttttttttttttgtagagatggggtttcaccatgtttcccaggctggtctcaaactcctggactcaggcaatctgccagcctcctgagggagtgctgggattacaggcatgagccactgtgcccaccccctttttccagtattacctggacaatgtgtctccctgtcagtatccagggaatggcacctggatcaagcatttagtgttcagttgctacactctcacctaatccctcattttcaatattttgccatgttttccagtgacccaactggccaccatgtcacagactttatggtctccaagggagacccctccatttcatgttttgtgatttgagcaacagactggaatctacttgaaatttgcaaatggtctttgacttgggctttccaattttgctctacttcacagtgttttctgggttatatacaagggagatgatccagtcatttgttaagcgcctcaaataagacatgccctagatgtttttttgcttgtttgttttgtcaaattgggattatttttgtgtctttggagaatataaaatactaatatgaggtaagcactaaggttctgagatggccgtggaagagatgacaaactccatcaccatgcctgagagtgtccaatcgtctctgcgggggccacatatttttgtattacactgtatttgaaataacaacaacaacaaaaaacccttcaagattcataaaattggacaactgtctttgtaacacttctagtggtaaaaccagtaaggatggctagtttgcaacccatctgagcagcctctctggtttcatagatatgttttctctctgacattgaatggctttcaacttgaagcggaatgctacatcacaaagataaacaggtttgaaaggaaccggttttccttgtaatcctaaacgttcaagtctgcgcattaaaagacattatctgaagaagggtgcaaaagcttcctgttggccgccagaagggttctctgcaggacacagatcaagtaccacagtcttagggggagaccagacgcggggtctctgcgcacctccccaaaggacaatggcaggaggaaaaggagaaagagacagacgtcacttccttcgccagctccggcagcgggttgatcggctgagtcggcggagggtggggcggaagagcagacggggactgggaaaggcgctgttagtgacatcacggatagggcgatttctatgtagatgaggcagcgcaggggctgctgcttcgccactaaggagttcccgtgccgtgggagtgggttcaggaccgctggtcggacctgagagtcccagctgtgtgtcagggctaggagggctggggggggcggggaggtgcgcggggcaagtgaccgtgcgtgtaaagggtgaagcgtgtgaggctgtggcggggcggaggtgcaaaagctcatacttacctggcaggggagatactattatctaaacgaaggtggtttttctcagggcgagggttatccattgtgttccggatgtgctgacctctgcgatttccccaaacgtgggaaactcgattgcataatttgtggtagtgggggactgcgttcgcgctttcctctggtgcttttgtggtgcgaatagtaggtgagccgtaagtgtttttgtaattcagggtgcgggctcgtgttttgtggctgtgttctgtccggtcagttgtttccgttcgcaacggttagttttcgtttgtgaggccatgtttggggacagcttagaactatccacttactctcttgggaggcgaatttcagtctctgttggttggggtgttctcccaggttagctgccgctgtacttgctaggtggagctcagggatcaagggtcgggagctttctggtttgttcagtgctcccagggcttctaacatctcttaaaaactctggtgttttctgtcatcctcggagttacctcttagcctctgttttttttgttgtttttttccccccctccctaagacaagtctcgctgtaccgtccagtctggagaagtggcgcgatcttcccatctcaggctcccgagtaggacaaccacacgccaccacacctggctagttttttctctttttttttcttttcttttctttctctttcctttctttttcttttttcgtagcggtttcaccattctgctcaggctgggctccaactcctgggctcaagtggtccgcccagccttctgaagtgctgggattacaggtgcgatccatcttgccctggcagctcctgcttttcaccacagcattcacgggagtttgtaggatttctgtgttggggaaacgtgtactcagttaatagagccaggtggaagttgtactcagaactggtggttttctttggaatgaaaaccgtgcatgttgggggctcttagtgtccccgttcggttgtagacataacacccttgctttgtgtagggggagggctttgcccatgccctggtgccctggcgcagggcatcgaggcctgcaggtcagaaccgcagtctaacctatgtcttggcggaataccctgctaattctccctggaatgtaagatgggaggtcttgtgaggaggtttctacaagtaagaaaacaaatttccattcggtttttattgacaaaattgaaaattataataactgagtccagcctctcagatgacaaatgtcttttgcactgagagctgggaaccgccgcttgcctcagctcctgcatgcaggtgcagccctcgcttccctccacactttctccagcgggtgtcagttcctccacaagaggcagacagcgttctgcagaaccacagcgctcaaggccttcgagagccaaaaatctcggagcgagctgccctgtcctggctgtacctcacgactgacctagaaatggcctttgctgggagcaaagggtaggggggagattgtcgtcggagctggggcctgtgcactggaccaggttgaccacgggaggggaggtacccagagttagaagggggccaagcactgagacctcaccatcctcaatctccaaaaggactcagagagatgcagagactgagacaggcttcctttttcaaggaaagagaaaactactgaggaaggccccaggggctctgaaccaaaatccagacttttttttccacctgcagctttttgtttttatttttgcttgagaaggggtctcggtctgttgcccgggctggagggcagtggcgcaattttggctcgttaaaacctccatctcccgggttcaagcaattctcctgcctcggcctccctagtagctgggactacaggtgcccgccatgacgcccggctaatttttgtatttttattagagacgaggtttcaccatgttggtcaggctggtctcaaactcctgatctcaagtgatccacccacctcagcctcccagagtgctgggattacaggtgtgagctaccgcgcccagcccgcacctgcagcttaatcccatttcgctggtgcaacttcatccttccgtatgctcaggccaataaacagtactgtaggctggtcgttctttgacccccatacatcctattggtcggaaaattatgttttctctttggttaaccgcagactttgatatgcacactctttcttggtctgaaacccacccaatagtcccatacgtagatttttggataaacatagaaatggacccttctgatctgaaagtttgaaactcgatatttgttttatttgagttccttccttcaggcctctcaaaaaagatatcaaagaactgaaagtcacccagacaatgagatgccggacccctcattcatcctgattgcttccttgcccctccctagttcctgttttctttcttttcttttttctttttttttctttttgagacagagtctccctctgcctcccacgctggagtgcagtggcgctatcttggctcactgcaagctccgcctcccgggttcacgccattctcctgcctcagcctcccgagtagctgggactacaggcgcccgccaccaagcccggctaatttcttttcgtatttctagtagagacggggtttcaccgtgttagccaggatggtctcgatctcctgacctcgtgatccgcccccctcggcctcccaaagtgctgggattacaggcgtgagccaccgtgcctggtctagttcctgttttcttacacattgtcacattctttccctgccatctaagcctctagttttggttggtcagggagatggatttgagactgagttctcatctcctccgctgcagcaccctattaaagcctcttccttggcaataaccatctcagtgattggttttctgtgtggcaagcagctggaaccccaggtctctgaactttggcaaaggaatctcctgataaaggcgagatcgattttactgaccaagctgaaaacgatcagacgtttgaaagccttaatctcggagcctgtcggagtttggtctgcccttgaggcttttctttgggcctaccagtcaaaatcagcctggccaaacctgtcttcaaggaccaggggcagggccggcttctcccgccgggtcggcagccaccttccccttccctgtgacttgaagagaagcttcagggggcgtttattcaatttgcgaggagcccgcgaggagcaggtgcgcggtgactctgtggatcccaccgcacccgctgccctctttggtcctctcgctgtcaccggcgggcagtaacgttccgggtgagctagggctccgaagacagcaggcagggagggaccagtgggtaagggcaccgcccgtttaggtcctgcgcaggagggatccgaaaaaggtcttgaagaaatagaaagggagggccagatgcggtggctcacgcctgtaatcccagcactttgggaggccgaggtgggtggatcacgaggtcacgagttcgagaccagcctggccaagatggtgaagccctgtctctactaaaaatacaacaagtagccgggcgcggtgacgggcgcctgtaatcccagctactcaggaggctgaagcaggagaatctctagaacccaggaggcggaggtgcagtgagctgagactgccccgctgcactctagcctgggcaacacagcaagactctgtctcaaataaataaataaataaataaataaataaataaataaataaatagaaagggagagttggaagtagatgaaagagaagaaaagaaatcctagatttcctatctgaaggcaccatgaagatgaaggccacctcttctgggccaggtcctcccgttgcaggtgaaccgagttctggcctccattggagaccaaaggagatgactttggcctggctcctagtgaggaagccatgcctagtcctgttctgtttgggcttgatcctgtatcacttgattgtctctcctggactttccatggattccagggatgcaactgagaagtttatttttaatgcacttacttgaagtaagagttattttaaaacattttagcaaaggaaatgaattctgacaggttttgcactgaagacattcacatgtgaggaaaacaggaaaaccactatgctagaaaaagcaaatgctgttgagattgtctcacaaacacaaattgcgtgccagcaggtaggtttgagcctcaggttgggcacattttaccttaagcgcactgttggtggaacttaaggtgactgtaggacttatatatacatacatacatataatatatatacatatttatgtgtatatacacacacacacacacacacacacacagggtcttgctatcttgcccagggtggtctccaactctgggtctcaagcgatcctctgcctccccttcccaaagtgctgggattacaggtgtgagccacctcacccaggccattttaattttaatttaatacttttaatttgaatacacaatccaaaaatcatataacaagtacaggaaacccactttatgccaagtttacaaaaacaggaaagatatgtcaatgacaaagcgtcaaagtggcaacatcctaaagtactgagagaaaaaaagttattctagaattctatgccaaattgaaatatctttcaaaaatgtgactgaaatcaggacatttaaagacatacaaaaaaatgacagaattcaccgaaccacactacaagaaatattaaaggagtcctccaggcctaaggataaggataccaaacagaaatctgaacctacacaaagaaatggagacgactgaaaatcgctatgtacgtacttggatgttggggtttataacatgtccaaaatcaaattccctgacaacactagcataaaggccagaaggggaggtataatgtcacttgatggcagacagataaagatgtattctagggaccctaaagccatcactgacataacaaaagaaagagttacagctaataagccaaataaggaaagaaaatagaatgatatatattaaaaaaaaatgtaatcgctgggtgcggtggctcatgcctgtaatcccagcactttgagaggccaaggcaggcagatcacttgaggtcaggagtttgagacctgcctggccaaaacggtgaaaccccgtctctactaaaaatacaaaaattagcccgatgtggtggctcgcgcggacctgtaatctcagctacttgggaggctgaagcaggagattcgcttgaacccgggaggcggaggttgcagtgagagctgagatggcgccactgcactccagcctgggtgacagagcgagactctgtctcaaaaataaataaataaataaacaaacaaaaactgtgtaatccctatgctggagcaactgctctccaggcctctaccctatagaaatacacaaatggccaatgagaagtgtacaagaatgatcactgccgcattatttgcaatcataaaatagtagcgccaaagtaatttcaaagatacatgaaaatcgttttatttatttaacaaacacaaacaattgaacaaacaatggaagcaagtccttttgcctaaaggaacacagagggtcatgcggatgttgctcctccaaggatttcggtgttccccaacggctagttttgggtctagttcttctggaagaccttattcttggggagctacaggttctggcgtttggggctctttcaggttctatctccattttcccctcaattcctccccattctgctataataaaaaaaaattctcacctccggaagatcccgcctgtgcctccccgccagcctttcaggaggtctggacgtctggtccaccgctccccggcttctttcaccgcttttgcttttcccttcccctgctcccgccctccggcctcaggacccgaccaccgcccagctgagcccccgcggctccacggcgcagaaggtgcactggaggccctgcccgttgccgccccgcggggtgccaagaagtcaacgtaaataaatgctttgtaaaaggaacttccccatggaaaaatctctcatgatttccattctcaaggctcttcaaaggactaaaagctaaaaggatggattcattcgacaagtcctagtcctgcgccctggtgagtgccagaccctgctccccacgagggggacccacgagccaccctcaccacgatccctgctctggtggagcccccgtgcggaacacaggatccgaagatggcagcggaagctccgcagcggccccaaaagcgactgggcagggagggcacaggctccctcactgggtgaagtcggcgcaaagaacgggaagagccatcccgggagccaccgggcgttcagcctccctagggcccccaggcggctcgggccggggtctcaaccggggcgtttccgggggtttctgaagcaggcgaggggcagggcgggccaaggccattcggctatccttctggctccagaatctcccaacgcgcaggtgtccaacgtgaccagcgcgacttaccactccaatctctccggtcttccaaggccttgctcagtcgtcctgccgggcgggccctgaggatgcaagggacggaggaagtttcgtgcgtgcgcccttcctatagcgcccagtagaactgactgacagtacctgtctctgtggcgtagtcggttagcgcgttcggctgttaaccgaaaagttggtggttcgagcccacccaggaacgcttgttcgagcttttaaagtattcatgcattgtcaatcactagataaatggggaaaattttatcttcctggagtcctaagccactaatttgtgacttatccatgtcaagggccagcctacctccccgaccggattcttaaccgggtatctcctgaaatcctgggtttatacgtgtgtaactcaggaatcctgaaacagagacctaggaacccacttctggtgtgataaaattctaattcagtccgttatacgcttaaacgagtaatttacatgcctccattttttcatattttaataataggaggtcagtaatatcccgaggatgtgcctggatttactgattgctctatcaataatgtgaccagtggaatcattcatcatcatagtgatcctctccatcatttttgaaaagagtatttttcctcagtttgtgcatgatttatttaacccttttcaaaatgtttttgttagccaggcatggtggcatgtgcctgtaatctcaggtacttgggattctgaggcaggagaatcatttgaacctgggaggtggaggctgcagtggaggctgcaccagtggaggctgcaccaatacactcccgcctgggcaacagagcgagactccatctcaaaaaaaataaaaataaaaaaataaagtttttgagatgaggtaggtttcattgttttaggattacaaagaatgctgcagccacctttcttgtacacatatctttggtcattgtggaaatgtctacaccgcagatatttctatagtgtagggaagttgatgcactattgctacattatagggtttacatgatgcttctaatttgagtacattccgcaaatgtatctttcacgggagccgtaccaaataatattccaatagcaatatttataggaggaaaaatgtgcagaagtgcaactgagcttcgtgcctctccatggggcccatgttcataaaatggtggcattagcaatcatctgagagtggagtttgtggccctctgacatcaaaagctgaagcagaggacatgaaaaccctcactgtgcatcctctctagtctggccagaatcattcctaggtcggtggtctcttatcaggagggaatgctgcttgcttgttttgtcaaaatcacaaaactgaggaaaagcatcaggccgttggttgataacagtggtgaagcaagtctttccatagggctggtttgttgttaacccttagggaaaaaaaaaaagccgtttttttttttttgagacggagtctctctctgtcgcccaggctggagtgcagtggcgcgatctcggctcactgcaagctccgcctcccgggttcaggccattctcctgcctcagcctcccgagtagctgggactacaggcgcccgccaacacgcccggctaattttttttacttttagtagagatggggttttaccgtgttagccaggatggtctcgatttcctgacctcgtgatccgcccgccttggcctcgcaaagtgctgggattacaggcataagccaccgcgcccggccaaaaaagcctaattcttaccagctggtgccgtgcagttccaggctcttggtgtcccaaacaaagacaccaagagcctggaactgcaccaaaaaccaaaaccaaggtaggggcaagatgataatcacagaatgtcaccggtatatgtttaggttcaaatactattatgagaagtggcaggtaaaggaggtaggaaaaagaaaacacatcatgtaattgactgttgtatggaaatatttgatgctgaaagttataatttaaaactataaaccaaatattagaagtgtgtctagttcaaagggaggaaaaccatcaaaaacatttttagtgcaatatttaacatgagctatacaacccttcctaaatgccaaaggcacacacagacacacacacagacacacacacacacactcacactcacgaagaatacaaatgactagaaccaagcaatgtaaatacattctgctacgtatggtaaacatagcctacaatgtggaagagattagaaaataaacatggaaatgaaatgtttttattaattcgcatcagtacccaccaaaaccaatcagcataatcaaatattataacactgaatgtaaaaaacaatccaaaagtccagagtgatagcaaaaggttttaattgtatagattaaaattaactttggacaaaaattaaaactcaggcagagaatgttttcttctttttgcaacagcagacactagtaaaaacaaaggcacagtaaaaattgagacccaaaatttgcagtgtagagatatgaatataataatagacacaggcagggaggattaataaatgataaaatgtttagaggatgatcattagaatacaggatatttatactcttgaaaaccgctttcccaagtacttcattataagtaaggtgtctctaaaagggacagatctcctagacccctccttaaccaagtaaccagtcctgatatcataatggtgatggacaaactagaccttctctgcccgcagatgggctgaggttggaaactcacagcattgtctctgcagtgttcccggcaaaacgtttaggctgaatttaatcatgaagacattttcagacaacttcagaatgtagatcattgagccagacagctgacctgtcctctataaacaagtccatgtcaccaccatccatgacaacaacaaaaagatgaggaaatatttggggttcaaaataactaaagaaatgcagctacattatctttttactttttttcaaccgaaaatatctcttctcctttttgttgtgtgatttgtggtgatatggactatgtgaaggagacaggtcagttgtcctgctcagtgttctacattctgcagttgtctggtgattacctcctatgaaactcaggttaagcgttttctgcaagaacatggcattgctcatattctgcaccggcagagtcctgggtgacatgctgtctcctgccagcggctcctgactcctgttctctacaggatggaattgagaggagcagggctaaggcctcccaatgctgtttgtccatctagctgtggtcttcctaagtactgacaccaattggaggctgaaggactgtggcttctctaaccaaaggagcctagcgggttaacaattgtcaagagcagttggtggttctgaaatacaatcctcagccaaggatccctcctgtgttacagatggatcagctaaaacaagccaacactgaagacacaaagaatgaggttaggttcattgaaaccagggtaacacctttggatgagctaaacacaaagatgacaatgaccttgagcaggtatagaagctcagagacatgcctgcaaaatgacatccctgaggaattttgtagctacccagagatacgtggttcaaattaaaatgtctgactgatcactcccggcatgtgctgcacagttatgtgaacgtgtcacacctaacgtgggtccattgtcttcagactgagcacaggttgccactggcatggtttgagaataggaatagagccatgcccactgacccatcctatgtctgggcttccaaatggaactgtactttcattcaaatcttcacgtgcctataggtcctgcctgcaggaatgacacctctcggcttagtaagggctgcttattgtgggaatatgactcccatctggaacaccaggtggagacttgtcaccgtcaaagtaaaaaacctattgtccacgtaaagggcgaagctgatatgctcttcctcaaatgagtaaaacacacttctgtagtgctggaatgagtcaggtagttcaaagtacattgacggagtcgaataacatatatccagtgagtcctgcaagacttcaggctcttccacttccatcagcatgctgttgagcctgcaaaaggagacaaaactaaagaagcagccagggaaaatcggacaccacagagccccactagatttcagaagtaacataaggaagtggttagaaaagaaaaaggatagatccattaatgaggtaaaaaaaaaatttattgcctttatgttgggatagaacagggccaggtagaaaacaatgaaagagaaagacagagagagagagacagagacagagacagagagaaagtgacctagtgaattggccaggtgacatactggtaagggagtcaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctgtggtacgttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacactgtgagagatatatttcaggaggcctgaaggctggtcatgatagaaattcctcggtttttctcccagaaactgtgggtaaaatgtccctattctagtagatcgttatcccaatatcatttgtcccaaatttgtgcaaacagttatgccatatttttacaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgagaataggatcagggcgccacaggtatggcctgagactaggaagagagtcttgctcactgacccatcccttgtctgggcttccaggtagaactagagtttcattcaacctacatgtgcgtataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacagagagagagagagagagagagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgagaaggggaggaagaaatggaaacctaaatatctactgcaatgaaaaccaacagcaatgttagtaggaataattcaggcttggttgaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttaattcctgcaatacattcagacagggacagacaaaataagccaattcacctacacccataacagtccactgtctaatccccacacagggatctcaggctcctcagcatgagaacaggacaatgtgagagatgtacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttgagtccaaatcatacttctgtgaattttttacatctgcctgggtccaatgtgctgagagcgggctcaggttgccacaggcatggctggagactaggaatggagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcatagtaaggtactcactgtccacgtcaagagccaagccaaggtactgttcctccaatgagtaaacagcactgctgtagggctggcctaagtcaggcagttcaagataacctgaaggagtcgaataacatctacccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttaggttgggatagaccagggccaggtagaaaagaatgaaagagaaagacagggagaggcagagagagagagagagaggagaaagtgagctcagcgagttggccgggtgacacactgatgaaggggtcaaaggacactctgagttagtgccctcgggacacacagggaacagtgatcatgaaaagagtggactcaataattttccataaacttgctcaagattccatgcagttgccatacagcctttgaggtatggtcaacctatagaaagttagtaaatgataaggggaggaagaaatggaaacctaaacatctaccgcaatgaaaaccaacagcaatgtcagtaggagtaattcaaccttcgttgaaaacatgaaattgaacacactcttgttttccctggacctggcatctccaggtgtcaacacagaattcagcatccataattgctcaaagttacctggggcatgatgggtcttggtcttcttccacttcttggtacttttcaatttctgcaataagttcagacatggacagatatattaagctggttctcctacacacataacaatccactgtctaatcttcacacagggacttcaggctcctcagcatgagaataggacactgtgagagatattcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaattgcccccaaatggttgctaggagaaaaactgcactattcagccctgtctcatcaaatactcagattgttcatggtagcgaggattttagacgctgaaattagagtgaaggatgaaatctacaagatctacaaaattgagacaaaatcagagttgtgtgaatttgtcacatctgcccaggtccaatgtcatgagagtaggattagggcgccacaggcatggcctgagactaggaagagcgccttgctcactgacccatcccttgtctgggcttccaagtggaactagagcttcattcaacctacatgtgcctataggtcctccctgtggcaatgacatccctcagctcagtaagggccacttgcagtaggaatatgaccctaaccagaagactcagtggatccttatcaccttcatagaaaggtactcaccatccatgtcaacagccaagccaacacgctgttgctccaatatgtaaaaggcacttctgtagggctggcatgagtcagtcagttcaagacaacctgaaggagttgaatagcatctatccagtgactcctgcaagacttcaggctctttctcatccaacagctccccgctgagcctggaaaagtgggaaaaagtaaagaataagccagggggaatcagaaaccacacagctccagctagatttcatggctaagataaggaactgtttaaaaagaaaaaggacagatccattactgagggaatgaattattgcctttaggttgggataaaccagggccaggtagaaaagaacgaaagagaaagacagggagagggagagagagagagaggagaaagtgagctcagtgaattggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttactaaatgataaggggaggaagaaatggaaacctaaacatctactgcaatgaaaaccaacagcaatgtcagtaggcgtaattcaaccttcgttgaaaacatgaaattgaatacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatattcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcatggtagcgaggattttagacgctgaaattagagtgaaggatgaaatctacaagatctacaaaattgagacaaaatcagagttgtgtgaatttgtcacatctgcccaggtccaatgtcatgagagtaggattagggtgccacaggcatggcctgagactaggaagagagccttgctcactgacccatcccttgtctgggcttccaagtggaactagagtttcattcaacctacatgtgcctataggtcctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatatgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaataaaaaggacagatccattaatgaggtaacaaattattgcctttatgttgggatagaacagggccaggtagaaaacaatgaaagagaaagacagagagagagagagacagagacagagagagagacagagacagagagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctgtggtacgttagtaaatgataaggggaggaagaaatggaaacctaaacatctactgcaatgaaaaccaacagcaatgacaggaggagtaattcagccttcgttgaaaacatgacatcaaacacactctggtttccctgaatctgttgcctccaggtgttaacacagaattaagcatccacaattgcgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacactgtgagagatatatttcaggaggcctgaaggctggtcatgatagaaattcctcggtttttctcccagaaactgtgggtaaagtgtccctattctagtagatcgttatcccaatatcatttgtcccaagtttgtgcaaacagttatgccatatttttacaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgagaacaggatcagggcgccacaggtatggcctgagactaggaagagagtcttgctcactgacccatcccttgtctgggcttccaggtagaactagagtttcattcaacctacatgtgcgtataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgcttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacagagagagagagagagagagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgagaaggggaggaagaaatggaaacctaaatatctactgcaatgaaaaccaacagcaatgttagtaggaataattcaggcttggttgaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttaattcctgcaatacattcagacagggacagacaaaataagccaattcacctacacccataacagtccactgtctaatccccacacagggatctcaggctcctcagcatgagaacaggacaatgtgagagatgtacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttgagtccaaatcatacttctgtgaattttttacatctgcctgggtccaatgtgctgagagcgggctcaggttgccacaggcatggctggagactaggaatggagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcatagtaaggtactcactgtccacgtcaagagccaagccaaggtactgttcctccaatgagtaaacagcactgctgtagggctggcctaagtcaggcagttcaagataacctgaaggagtcgaataacatctacccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttaggttgggatagaccagggccaggtagaaaagaatgaaagagaaagacagggagaggcagagagagagagagagaggagaaagtgagctcagcgagttggccgggtgacacactgatgaaggggtcaaaggacactctgagttagtgccctcgggacacacagcgaacagtgatcatgaaaagagtggactcaataattttccataaacttgctcaagattccatgcagttgccatacagcctttgaggtatggtcaacctatagtaagttagtaaatgataaggggaggaagaaatggaaacctaaacatctaccgcaatgaaaaccaacagcaatgtcagtaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatattcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcatggtagtgaggattttagacgctgaaattagagtgaaggatgaaatctacaagatctacaaaattgagacaaaatcagagttgtgtgaatttgtcacatctgcccaggtccaatgtcatgagagtaggattagggtgccacaggcatggcctgagactaggaagagagccttgctcactgacccatcccttgtctgggcttccaagtggaactagagtttcattcaacctacatgtgcctataggtcctccctgtggcaatgacatctctcagctcagtaagggccacttgcagtaggaatatgaccctaaccagaagactcagtggatccttatcaccttcatagaaaggtactcaccatccatgttaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctctctgctgagcctggaaaagtgggaaaaagtaaagaataagccagggggaatcagaaaccacacagccccagctagatttcatggctaacgtaaggaagagtttgaaaagaaaaaggacagatccattaatgaggtaacagattattgcctttatgttgggatagaacagggccaggtagaaaaagatgaaagacacacacacacacacacacacacacacacacacacagagcgagctcagtgaattggtcaggtgacacactgatgagggagtcaaaggacactctgtatttgtgctctcaggacacacagtgaacagtgatcatgaaaagcatgtcctcaataattttgcgtaaaatgtggtcaagtttccctgcagttaccatgagaatacagcttttgaggtatggtcaactttcactaggttagtaaatgataagggtaggaagaaatggaaacctaaacatttactctaatgagaaccaaaaagcaatgtagtaggcataattcagacttgtctgacaagacaaaatcattattttcagcatgtactgttttccctggacttggcatctccaggtgtcaacatcaaattaactgtccacaatttctcagactcacctgggacctgttgcctcgtggtcctcctttttcacttgatcccaccgatgtcctgcaaataaattcagatgggccctcttacattaagcagttcttccttgcacacagaaacattcctctgtccaatcctaacacagggacatcagtcttgtcagtgtgagaacaggagactttgagagaaatattccagtaggcctgaggtcaagtcttgagaaaactggcttgggttctttcatgagccttgggcaaaattcccctgtgttggaatgttatcttccctatgtgctctgtcctaggtttatgtacacaaatgagcaattttttccccaataaattgtaggcaaatagttctaacacctcataggagagatacttcaatattaggcttttctcattaaatacccagaatttgatagtttatgagattgtggacacagagatttgatgaaagggtgcaatgtaccagctcttgagtcaaaatgaaacttggttctacacagaagcatcagctattatggcttttgtgggtgaaaagtcagccatttatctagaaaacataccaggaacatgacggacagatgagctaaaacaagcgaacttagaagacacagaaaatgggaataaattcagtgaaacctgggtcacatctttcactgagaggtagacaagggtgacactggccttgggcaggtaaagaaccacacagacatgctttgggaacaaaactcataaggaattttgtagctggcaagagacatttaattcagatgagctgagctgacagacaactcctgggcatgtgctgcatagtttggtgtgagtttgccacacctgccttgagttcaatgtcgtgacagtcagtccaggttggcacgggcatggcctgagactaggaagagagcaaagctcactgacccaccccatgcctgtgcttcagactcgactccagagtgattgaaatctacattgatatataggttcagcccacagtgatggcaaatctcagcccaacaaggggcacaaggcccaaagattatggggtctacctgggccatgaactggagctttatcaccttcacaatggagtactcactgcctatgtcaacagccatgcagacttgctgttcctctaatgagtgaaatgtgctgctgtaagacttgtacgaggccaacatttcaggaggaattgagagagtcgaataaccttcatcccaggactcctgggggacttcctcctcttcagactcctgcagattcctgatgagccaggcaggacagggatgacagaagatttaaccaacagactttagacaacaaaacctcccagatgatctgatgggagacagaatggagtggtcacagaaaccaaaggcatttttccttcaagaggaataaaactatccttctaaatacagggtggagggtgactgctctggggacagagcaaaaatgggcagcgtgtgctcagtacatttgccacagatgagccaactcagggcacccagactctccctgtaaactaccatcatgacttgcagcacagagaactgacacagggcttcaactactttgcataaattgggttgaattttacatgcagcattcaagtgaagagagttcttgacgcagtgcagacacagatcttgtgtattaagggccccattttcccaatattttgatataatatatttactttttcaatttcttttcttgcaaaaatactagccaacatactaccaacaaataggaagaaagcatatatacacctctccctggatttaaacacatgggagagaataggcaacaccaagaaatccctgtttgagggtctggagtggacttccagcaaactccaacagacctgaagctgagggacctgactgttagaaggaaaactaacacacagaaaggaatagcatcaacatcaacaaaaaagacatccaccccaaaaccccatctgtaggtcgccatcatcaaagaccaagggtagataaaaccacaaaggtggggagaaaccagagcacaaaagctgaaaattccaaaaacctgacatcccttctcctccaaaggatcgcagctcctcgccagcaatggaacaaagcaggatggagaatgactttgatgagctgacagaagtaggcttcagaaagtcggtaataacaaacttctctgagctaaaggaggatgtgcgaactcatcgcaaggaagctaaaaaccttgaaaaaagattagacgaatggctaaccagaatgaacagtgtagagaagaccttaaatgacctgatggagctgaaaaccatggcacgagaactatgtgatgcatgcacaagcttcagtagccaattcgatcaagtgcaagaaacggtatcagtgattcaagatcaaattagtgaaatgaagcgagaagagaagtttagagaaaaaagagtaaaaagaaatgaacaagcctccaataaatatgggactatgtggaaagaccaaatctacgtttgattggtgtactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaaaacacataattgtcagattcaccaaggttgaaatgaaggaaaaaatgctaagggcagccagagagaaaggtcggattacccacaaagggaaacccatcagactagcagcagatctcttggcacaaaccctacaagccagaagagagtgggagcaatattcaacattctttttttttttccatatgtatagttttcctttattattttttgtgtgtatgtatatatatatatatatatattttttttaatactttaagtcttagggtacatgtgcacaacgtgcaggttagttacatatgtatacatgtccacattggtgtgcttcacccattaactcatcatttaacattaggtatatctcctaatgctacccctcctccctccccccaccctacaacaggccccagtgtgtgatgttcccctttctgtgtccatgtgttctcattgttcaattcccacctgtgagtaagaacatgcggtatttggttttttgtccttgcaatagtttgctgagaatgatggtttccagcttcatccatgcccctacaaaggacatgaactcatcattttttatagctgcatagtattccatggtgtatatgtgccacattttcttaatccagtctatcattgctggatatttggcttggttccaagtctttgctattgtgaatagtgccgcaataaacatatgtgtgcatgtgtctttacagcagcatgatttataatcctttgggtatacacccagtaatgggatggctgggtcaaatggtatttctagttctagatccctgaggaattgccacactgccttccacaatcgttgaactagtttacagtcccaccaacagtgtaaaagtgttcctatttctccacatcctctccagcatcttcaacattcttaaagaaaagaattttcaaccaagaatttcatatccagccaaacaaagcttcataagtgaaggagaaataaatcctttacagagaagcaaatgctgagagattttgtcaccaccaggcctgccttacaagagctcctaaaggaagcactaaacatggaaaggaacaatcggtaccagccactgcaaaaacatgccaaactgtaaagaccattgacactaggaagaaactgcatcaactaacgggcgaaataaccagctaacatcataacgacaggatcaaattcacacataacaatattaaccttaaatgtaaatgggctaaatgccccagttaaaaaacacagaatggcaaattggataaagagtcaagacccatcagtgtgctgtactcaggaaacccatctcacatgcagagacacacataggctcaaaataaagggatggaggaagatctaccaagcaaatggaaaacaaaaaaaaggcaggggttgcaatcctagtctctgataaaacagactttaaaccaacaaagatcaaaagagacaaagaaggccactacataatggtaaagggatcaattcaacaagaagagttaactatcctaaatatatatgcaccctaaacaggagcacccagattcataaagcaagtcctgagagacctacaaagagatttagactccacaaaatcatcatgggagactttaacaccccactgtcaatattaaacagatcaatgagacagaagcttaacaaggatatccaggacttgaactcagctctccaccaagcagacctaaaagacatctacagaactctccaccccaaatcaacagaatatacattcttctcagcaccacatcacacttattccaaaattgaccacatagttggaggtaaagcactcgtcagcaaatgtaaaagaatggaaatcacaacaaactgtcagaccacagtgccatcaaattagaactcaggattaagaaactcactcaaaaccgcacaactacatggaaactgaacaacctgctcctgaatgactactgggaaaataacaaaatgaaggcagaaataaagatgttctttgaaaccaatgagaacaaagatacaacataccagaatctctgggacacatttaaagcaatgtgtagagggaaaattatagcactaaatgcccacaagagaaagcagaaaagacctaaaattgacaccctaacatcacaattaaaataacgagagaagcaaagcaaacaaattcaaaagctagcagaagacaagaagtaactaagatcagagcagaactaaaggagagagagacacaaaaaacccttcaaaaaatcaatgaatccagggctggttttttgaaaagatcaacaagaaaaccctgtttggctagttcacctggctcatctgatggcaagttcctatcttgagaggactatgaaattaaaaccaatacaagtgccacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggtcctttttcttcctcttcctcatcatcactttcattttctgtaaataaattcagagaagcaggtcacattaagcaattcatacttcacatatgaacaaatcactgtccagtcatagcacaaggacataactattctcagtgcaagaataaggattctgacaggaatattctaggttgtcctagattaactttggtgagaattagatgaccctgctttccagacccacaggccaaaatctccctctatgtgtagaccataatgccatattccctgcttgagtcaaagttaaacaaaattttttccccaaaaaaatctccaaaaattggtcaaacaattttctaagagtgttgctgcgatatggacttatatcaccaggtaacatggacattaaatgtttagaggcatctatacatgaaacacgactgatagataaatttgaacaactcttgctttaaaaagaatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagccaagatggtgccactgcactccagcctgggtgacagagcaagactccatcgcaaaaaaaaaaaaaaaaaaaaaaaaaaaaaaaaaatccacgatgctacaaagaaacattggatcagccattgcattgacagggtggagaaccagggtccagccttgctttatggaaatatatcagcaaagtaaagaagaaaagtttctgtcctgatttcagggtgactgtgcagctaagcaagctgacttaaaggagatccagatgaaagctgagagcagtgaagcctggtgaacaatatttccaaatacaaaggcaaggctgccagcttccttaaacaggcatagaaactccatggacattgttcagggacagatgacttaatcacagatgacaagagatattgaatcgaagctaggaggcctgacagatactgcctgtgcacctcctgcactcaggtgactatgagattgtcacacttgcctggggttgagtaacttgatactggggactggcagacaaagtcatgacattagctgagaaggacaaaaaactccctgatatctgtttagaaacccatcacagttttttattcaaatgaatttgtgtttatagagcctgtcttcagagtttatcttcctcagccaagaaagaggtatgagacacaaggaaaacagaggctacctggaataatgtgtacagcatcctcccattcaacatgagaggatgagccaatgagagttgagtcgactttgtcttcctcaaatgtgattttggttttcctatgtggctggttggagtcataagggccatggctatttgaacaagtgatggcacattcctccagtgagtcctcagggacttccttttcttcagccttctgcatctccctgatgagccaggtgggacagagatgacagaagattaaacacagagggattggaccccagggagtcctagctggttttgacaggcggcattaagagagtggtcccagaaagcaaaatggaggttcccattaagagggaacatgcaatcctgttctctctgcaacagagcatggctgccatgggaaccagagaggaagagagcagctgctgttcattgcactggacagataggagctgaggaggatgaagactcagctatccctgtacggtgcagacatgacactcggcacacatagagaaacatgacagctaccgcaccctgtgtctaagctgggttatatttcacatactgtggccaagcgaatgcgggtttttggcccatcatagatgccagagagggtgtgcctcctagatattcctcatatgttaccatccattaattgttcctgagtattcagtgttacctgggggcagacgatttctgcactttctcagccacctcaacttgaacatcttcatcgtcatcgttgtcattttctgtaaatacagaagtgttcgttcagatatttcccacttcacagtctgcaagcacagtcagcccaatgtgcaacagagacatgaacatctaggcatgggtcaccgttcaactgaaaactctcatgttttatctttaacagaatgccctggcatggtttcctgatccatcaggcaatgcatttctgatctggagggccaccatcaagatgtggccaaatattgaaaagaccttttgcttcccatatcactggaggcttgtgcagcctctctctggacgttggcagctgtctcccccatcctgccagatctgattcccaggcacaggcttggtgtcctgtcacggtttgcatttcaaacctaattctttctcttagaagcagacaaacttgtcccacagtcctctatgcatcagaagatttcaagcctccaagtggcttctgctgtgttcttcagggacattctatccatggggagtgctccagtctgaagcacttcctaccacaaaacgcccccacataaagtgccttctccaacatcacacggcgagggacttcatctcattttggaaagcagttgtaagtgttcccacatttgaatgcttcagacccttgcaagagacaatttgtctgccacggagagagagaaactcaggaaggacaagtcattcactctctgacagttactaagaacattgtcgaaaagacagcctgggaaccttcattcttagtccagagctcttttcactctaacaagcctgctcccatcccagcctccttcctgtcctttaaaactagatagatgctgcctcttgctccaaagaccaccttccatcaaggaaggagggacacttgcaatactgtgacctccaaccccatgggtttcccatctccgttcttacccaagaagtcctggtcatgtcatggccacataagcttagtggaaaaaaacaccactgatacaactgtcattgtgaaagtatggaggtctggagtctctcataagcctgggattttgggtcatcagggcctatggccaccttacctgggctgagcttttggacaaggtgctgtgccagtctacacccctcagccagctgttcttggaggtcctgcccctgggacttgtccggctcatccggagtgaggagggcctggagatgctcattcaatgagcgggaggcatctctcccttcccgcaacttctcccttaactgggtcagctctcgttcctgagcgtgaaccaggactttatattgcctaaggtgagacggtagagaaaatttaagagtagaaagagttgagtgatccgctcaaatattgcaacagagatttctgagacaatgtcctcaaggagacctcgaagcagaaggtcagcacatgtttaaaggaatgtctgtggccaagagaaagaatagaaaatggtttacaggcttcctctgaatcagagagggctcttgcaagatcctcgatgatgttccattcatctttctcttctgtaaacaaaagtaggtgtcttcctaattccctttcaaaaagacatcctttcagttcctcactctggccatggacatttccatgtgaaaatacacatagtgcatcttgcggccactagatacaaagccatgtacagaaatgaggccaggtgcagatggggcgaattgaaaagaagaaagaagaaaagaatgacagggtcgagaaggcaacattgattgagtgaaagaatgagaagccgcagtcagtcaggaggtgattctcactaagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccatacatttttactatcctcctcctctgtttgataaatatttgtgtgtagcgagcctgccatggcaattcctgcccttcccctggcccagcttagctcttacgtctccccaccgagctgctgtacttcagagatttacacacctgcccccctgcctgcccccatggggtcccctcacctgagctcctcagcttgcttgagctgctctgcaagcttctcctccttgaactgtcgctcattcctcagcatagattttatgagatctttgcactcttcatattctgagaaaagacagacacacctgcctcagtggaaggctggacatgctgctgtggtcattgcctacaggacaggagccaggtccatcccaaggacaaaactctccccagtaccagggtctagacagggatttccacatctttactcttcagtctcctgactttctggcatctgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaagtggtttcggaagtgatcctgggtgagaggaggaggaggaggaggaggaagaggtggaggaggagggggaggtcggctttccatttccagatgtgaccgcccagctgctgctcgccgctgctggattccagtttcctccccttctggcgacggattggtgatgacaccgagtctcactttctccttcccccgccgggaccaaccgccgtggggggccgagggtgccggggacggccggagagcgatcacgggctgggcggcggaagccgacgaggggcgagccccgctccggctcaagcgatcacacccctcacggcccgcactccggccttccacacccgtgcacactctcgcccgcgggcggcggcagccgtgcccaggctgctgcagcgccacccgcccgccgcggaccctccgcgccctccgcctagtcacccggcccggccgcgggccgccggggctcgcagagtgtcagccatcccgggcaggagtcgcgtctccccaccccgacctccactcgcgccgggagctgagcggcagtgtaggtagtgaagactccctggggctcccagccttccctctccgcgctctccccccgtcacttttatgaattcgactccactttctaaaggaattatgagtcttgtggcaaacacaaaccggagtggccgggagggggaaaaggggggaaaagaaaatctttaaaaattaaaaaaataataaaacgaacaaatctttacttgttgccacctcagataacacggaaaaagccttgaaattactccagatgtgcaccctccccttccctcagtgcctgagtctttttcctccagatcgaagtatttcagcccttttggggcgccgtttgcgaaacacagccccttttgagggacttcctcctcttgaaaagactcaccagttctcccttcctaggtgtttctgttcatgagaaattgtcagaatcaactggcacgttccagggtcttcctaaaggatggaaacctgtttggcttgctttttaaaaccacctcctttgacagtcagtccagggaaagctacaatccaggtgttcagaaatgagatactgctctgattctcactttctgttctgcctaaggacacctcaggctgacgtagctgccccacctctatattggtttatgccctaggagaggtctccagcaggcacttttcttgttgatcttttctccgctgagaaggctcccgccagtagaccatgactcgttttgctttgcattctcagtgccacgtacagtgcctggaatacaggagggtggcctaaatgttggctgaatgcatgaatggtcatttcttgcagcctcttttcattaccctgtctcatcagctttcttatcagaataagtgcccaagagtgccaaactgtttcagacccttaatcaatttagttctgattctcaccgtgacaacatgatgttcagcacggtaggaatgactgccatctctgaaggagtcttaagattctgtagaatcagtgaaagattctatgttctaacgcctttacctttcaggaaagaaattacaaaatagtttcattgtccagtcatattcactatgagttataagaggaaacattctatctagaattagaaataccatttgacccagccatcccattactgggtatgtacccaaaggactataaatcatgctgctataaagacacatgcacacgtatgtctattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatagatgaaattggaaatcatcattctcagtaaactatcgcaagaacaaaaaaccaaacaccgcatattctcacttataggtgggaattgaacaatgagaacacatggacacaggaaggggaacatcacactctggggactgttgtgggttggggggaggggggagggatatcactgggagatatacctaatgctagatgacgagttagtgggtgcagcgcaccagcatggcacatgtatgcatatgtaactaacctgcacattgtgcacatgtaccctaaaacttaaagtataataataataaatttaaaaaaaagaacaaaacatcacattgtaccacataaaaaaaaaaaagttggattttgcaaggaagatagacatctgactaaagtttggcctagcaaggaatctttgttagtactacttcttgtttaaggaaagaagagacactcatctttccttcaaacaatataagtctcttttcttgtttgatcaccttttattcattaaggaccagttgaatcatcagttgggacttggtagcagaggatatttcctggatagtgtgagctatcaggcctttaatgtgggaagtttagtttctataaaaataaaattaaaaaagattaatagttggaacaaactataaagacagtttctgagcccagagggcagctgatcaataagatttctagatgctgggcttgtagtatcttcagctggagtgagaagaggcattggattagtttgcagtttgaatgccataaagatgggccacacacaagctgttgtggtaatttttctgaagcttatgtcaagtcatccagtttcagtttgaaggacttcaagaaatgaaaagtttataattttagtgattccaagccagaatagcaggaaaaaaatgaaatattaatttggagtgttgtagctaaatattgtagtaagctagaaaaattgaggatctattgcagattgcaggcagataataaaacctcaggaaaaaaaaaaaacagctagaatctaatattgggtgcactgcagttttctcccgaaacataacttttctctctatattcactctcatttctgtcaaagataatcaaagtcagattgatttgtttgctaaataagtttaatctcattaaacttgtactggttttgtacacaagtgcagttaagagtagtgattgaccatttaggctcttttaaaggttgcgtttgtcagataagaaatctcagattaaactttttgtttttgtttttttagacagagtctccctctgtctctcaggctggagtgcagtggtgcgatcttggctcactgcaatctccgcctcctgggttcaagcgattcttctgctcagcctcccgagtagctgggattataggtgcgtgccactatgcctggctcattttttgtatttttagtagagacagggctttcaccatattggtcaggctggtcttgaactcctgacctcgtcatccacctgacttggcctcccaaagtgctgggattacaggcgtgagccactgtctccagtcagattaaacttttaaaagccacctgaggctgggatacaagcccaaaacttgtcattagtctgcacctgttacatttatagatttagataaatttctctcttcttgaggtccctaaaatatcccaaggtttccagacccaccaagcagtgacattctttacttacctgtaagtctgggaaccctagagccagtttttccaagatggtactttattggttccataaagccaaccttagtcccctaaagccttctggtcatatctgaaaacatgatgtttcagtcaaagccttggtgatataacctgtgtttccagtttgtcctgttacaaagacaacagattcttattaaacttatgcaaataaatacattgccataaaaataagaatatgcacaaatagtttccaaattctggagggataagttagggagaaaaagtaaatgtttccattttgcacaaaagtattctttactgaattggtgtaagctagagatagcttaaaaaaaagttttctgaaatctggaaaacaaaacatttaaagaactagcaatgtttccaacaaaaactcattttaaaaattattctcatcagttcattcagtaccatgtaattaaatcttgttttgcttgatcttgggttagtagttacatgaacccatcagttttattagagttctggaaattcttaccagtccaattgtatgacgttaaagttgttcagaaacctgtattccagaatagtcataagagtattttccataaatctccttgaagaagaagccattttggactgtagctaatttcaaatgcttttagagaacaattaaattaaaacaataactgtctacagatgacaaggacttaaaatgtccatggttaaaaaatctaatgagagttcattacaatgatgcaatttataagaaaatttggttagcatggcatacagcattttaacataataaccaaaattatgactgataacatactagatttctaggaatctcatacaacttttgtacacttatcccaataatatatccataaatataacttaaagatggcttagcatcactttttatttgaatgctacacatataatttagcatattaaataaatctaattggtttaatctctctttcatacaaaaaaaaaattctttgtggctttctgagggtccaatatggagaatcctaagttaatttgaggtcaaaaagacttaacttagaatgtgattttgggaagattgtcaaaaatgtcaaaaagtttaaaacatttaaaacaaatatgaccatagttatctatttaataaaagctccattaaaagattttaaaggcaaattcagattacatagttgtgaacaagaacttagctcctttaatattgagaagactcacttttcttaagtaaccaaaaacctaataaaacaacatgaaactcaagaaattatcttgatgaaacagagtctctgtttctgaggccaattacttaaaaggaaaaaaataccctttacattctcagaccaacattccaagaaaactttaccattttaacggagaagatcaaattctacttttgaatcaatgtattactaaaactaagttttaataaaaccttataaataaatctatccaatctcagtcagcttagaccatacaagataagattttcacaatccttctagacatcttttcttatttacttttgcaacagacatacaccagacaattaagcaatttacttttactacatattctactcttaggttgaatttatggttttatggccttaaacatctaacagtaacaacacaaacttgtctaatcagcaaagccaggtaaaacaagtgtatgctgacaattctgaaaatgtttctatttttattttaccaatattttttaaactagtttttatttactaaggaatatcccagattatgtgaacttaaaaaaaattgggtcagtttctacttttctgaaaattttatacattcttatttgtttgagtgctcatttatccctagccaatttgggtattttagtttggtaataacgttggaggtagaaaaatatcacatatacataacataataacatagatacacacatgtacacatacacaaacatatagagtgatgtaaccagatcttatgacttctcatttaaaaaattttaaccaggccaggtgcagtggctcatgcctgtaatcccagcactttgggaggctgaggtgggtggatcacctgaggtcaggagttcgagaccagcctggccaacatggcataaccccgtctctactaaaaatacaaaaattagctgggcgtggggcatggtggcgcccggctgaggcacaagaagcacttgaacccaggaggtggaggttgcagtgagccgagattgccccgctgcactccagcctgagcaatgaagtgagactctgtcccaaaaaaaaaaaaaaaaaaaaaaaagtttttaaccatgaggcagtaaaacagagtaatacaaaaatacaaactcactggtttatctccgctttatattgttatccaaattgtgtttctggtgaaaaagggataagttgagttgacctacataacaaaggctaaagctttttaccaatatttgtggaggaggttttttaagatttttttttttttttactttatcagtttccaaacagtttctttttttctcctattatcagccccaggtgcttgtttttgaggggcctctgagtcccttgagagccccctcaaaggagggtaggataggggtcctgaagttcagcagaaaagaaacgggtctggcaagagtggacagagaaatagtcagcagagacttgagaagaggggtttcaggtgacagagctcccatgggagaagcaggatccaatagagagaagagaaagagcagagtggttttatagagagccaggaagaacaatttgtagcccagggaatcagggaataacccctcactcagaaaaagagagccagaaagaagagacttctagcctagggactcagagaatagaccactcagaacaagaagcccacacgaagaccttcctgcccagaggattgctttcaaaagaagcctgggactctaccccagcttcagagagaatattcatcccttcagattcaaaatctgtccttagccatcaacgggcttttgtctggagcaatggctcaggaatctgattcaccaatggatccctaatcagtcagaaatgacaacaaagacttcaaaggcatgcatttagggttctgagtgagaggcccaggatccagtgatgaatctgtcctagttgagtttcaacaccatagttgttaaagaaaaaattattcagtgatacttcaaatgcacagtaaagaagactttattcaggaccatcaccatagatataggaaccactgcaacacagtcttggagctggggagagagatgggcttaactctgaatacagcatgcggaagtgggaatttatagcccaggagcaatgcaggggtcagtgaatggaaaatcactaagaggaaacatcaggagtaagggagattctggctaaaccgccctaaaagaattcttgctgaagactggccagggtgatcagacatcacctgcagaatggtgaagaatgaagaacctgatcagatattgagaatgaggggttctttggtaaacttggcagtgttctttgctaatgctggattttgcgaggaagtgcacagtttagcctagctgaagatttagaagcctgactaaagttggccaagcaaagaatctttgttatcaacatattccatcaaacctcacatccctgccttaaatgatcaaaccatccgcactcctgtatgctactgttctccatgaaaagttacttcttctttgccttaaccaaaatccagccattctagaaagacaccagaaggctttctgcagcatctaaaattccccacattctgggcccaaatccttttcctttccctgttgcttttagatccacattgtgtaaccctcatctggaaacctcagtttcttggagtcatttttttttggggggacggagtttccgctcttgttgcccaggctggagtgcagtggcatgatctcagttcactgcaacctccgtctcccaggttcaagcgattctcctgcctctgccccttgagtagctgggattacaggtgcctgccaccatgcctggctaattttttgtatttttagtagagacagggtttcatccttttggccaggctggtcccgaactcctgatctcagatgatccacctgcctcagcctcccaaagtgctgggattataggcgtgagccactgagccaggccattctgtctttttatataatgtaacttgtacttttatgtagtaaattatcacaatggtgtcagacactctgaggaagagtattttactgtatcattcccattacccaatcaggaagtcttaacaggcagattttaacaaaaatataagacacaactgtgccctagcttttctcacatacttcctacctcacacttcacacatttctttttctcagcacccactcttaagtaataatttatttcccctgaatattatttaccttctgtgggctactttacatatcatctgaaagcatgatcaaaacagttatatttgtgaataattttattttggtttatttcttagcagaaggaggagttaatagtaacatttgtaggccgggcacggtggctcacacctgtaatcccaacactttgggaggccgaggcttgcggatcatgaggtcaggagatcgagaccatcctggctaacacggtgaaactctgtctctactaaaatacaaaaaaattagccgggcgtggtggcgggcacctgtagtcccagctacttgggaggctgaggcaacagaatggcgtgaacccaggaggtggagcttgcagtagccgagatcgcgccactgggctccagcctgggagacagagcgagactccatctcaaaaaaaaaaaaaaaaaaaaaaggaacatttgtaatctcccagagattgccaaggaaaacattctcctggctgaatttatgtagagttcatcatctaagcataaaatattttataaaggaatgggccaatcaaataactgctatgcggttgacaccataaaccaagttagcttagtaccactctaaatagttgctgggaatataatgattttcaaagacatgatctctagaaataaataactaaaagagaagcacggtgtcatgcatttatgcatacacataagcagggactagagatcaagaatagaaataaaagaggtttttacacttggggtgctaaggtcgcaatgatttatttggagagaaaacggaagcccttctttagtaaatgcaaagcaccatgtgtttaatgaagatacatgacctaagctttgaagatcgtttaactaattcaataaccttaccaagtatccattactacatctcaacaatcaaatttacagtgacatctttgagttaaatctctccatagatgtctggaaacagcttaattctgttaactgctgcccattgaattatgctttatttggtcgtagaatttcatgtcatctgttagtctccctcacaacttgggagatgttattcctgtattgtctgttctcgttgatgaagagaagtctgtgataaagtaattgtccttcctttgcaggtaatctgccttccgtctctggttgatttgaaaatattgtattagtctttagtatcttgcattttactgtggtatgtctacataaggatttatacttactgagtttgctcagagcttggagtatttcctcagtcttaaaggccctagttgtgaaaatgttactacagaaaaactttctttttttaacttaaaatcctttttattgggaaataaatgtaagattatagataagtttgaaaataaaagaattgttagaacaaaaaatactcatatgcctgttaccctaatttgtctattattattttattaaatttaggttaccatttgttctctctctctctcaatatatatcccaattttcggtctttagatctaaatctttcagcaacctggactatcatggccccagtgtaatgcttggctttgtacctcatgagggaagaaatttttttttttaatcttaagttctagggtacgtgtgcaccacatgcaggtttgttacataggtatacatgttgccatgttggtttgctgtacccatcaacttgtcatttacattaggtatttctcctgatgctatctgtcctccagccccccaccccctgaaaggccccagtgtgtgatgttccccaccctgtgtccatgcattctcattgttcaactcccatctgtgagtgagaacatgcggtgtttggttttctgtccttgtgatagtttgctgagaatgatggtttccagcttcatccatgtccttgcaaaggacatgaacttatctttttttatggcttcatagtattccatggcacatatgtgccacatttttttaatccagtctattattgatggacatttgggttggttccaagtctttcctattgtgaatagcaccacaattaacatacgtgtgcatgtatacatctttatagtagcatgatgtataatccttcgggtatacacccagtaatgggatcgctgggtcaaatggtatttctagttctagatccttgaggaatcaccacactgctttccacaatggttgaactaatctatgctcccaccagcagtgtaaaagcattcctatttctccacatcctctccagtatctgttgtttcctgactttttaatgatcatcattctaactggcatgtgatggtatctcattgtggttttgatatgcatttctctgatgaccagagataatgagcattttttatgtgtctgttggctgcataaatgtcttcttttgagaagtgtctgttcatattctttgcccactttttgatggggttgtttttttcttgtaaatttgttgaagttctttgtagattctggatattagccctttgttagacgggtatattgcaaaacttttctcctattttttagattgcctgttcactctgatgagagtttcttttgctgtgcagaagctctttagtttaattagatcgcatttgtctattttagcttttgttgccattgcttttggtgttctggtcatgaagtctttgcccgtgcctatgtcttgaatggtattgcctaggttttcttctagggttttttatggtgttaggtctttcatttaagtctttaatccatcttgagttaatttttgtgtatggtgtaagaaagggatccagtttcagctttctacatatggctagccagttttcccagcaccgtttattaaacaggggatcctttgagggaagaaaattatttctaatattttaatccagctatgtatgtaaaaagaagtctttttcatattttatctattatttctgtatgattggagtatgagtcaaaacatctcaatataaataaaaagttacatttcagtaatttttttttctaaaattacaaaacactagtggtcaaaaacactactatttccaattctctttactttgttaacattactttttgtacttatgagagaagagtttgcaatccaaaaagagcaggaaggaagagagattagagattttttctcccgcttgctctatacatatgagatatttatatatctatatatcaacagttgacctttgaataacactggtttaaactgtgtgagtccacttataggtggattttttcagccaaatacagattgaaaatatagtatttgtgggacgtgaaacccacatatgtggagggccaacttttcatatgcgagctctgcaaggttgactgtgggacctgagtatgtgcagacttcggtatatgcagggctcctgaatgcaataccccactaatactgagggatgactgtatatgtctctatctatctactctatcatatatatatatatatatatatatatatatacgcacacacacacacacacacacaaatatgtgtatatatatatgtatgtgtgtatatatatatatatatatacttcctatattactttgctagggttgttataacaattactgcagactggatgagttaaacaacagaaatttattttctcacggttctggaggctagaagtgtgaggtcaaggcatcagatgtgttaattttattctgaaatttctctccttggcttttagatagtcattttctcatcttgtcttctcatggacttttttctgtgcacatgtatgtctgtacctaaatttcctcttcaaataaggacaccagtgatattggattaggacccagacatgtgacctcattttacattagttacctcttaaaagtctctatctccaaatatagccaccttctgatataccgggatggcagggggcagggtacagcatattaatttggggaaaggacacaattcagcctataacatatgcaatatattcttctctgatctatattatataacttttacatataatacatatataatttaatatacattttaaccccttgattaattttctcactgcagagaaaacaagaattaaagaaaagcttcaggtgataccatttttgaatgagtaagaattgagcctacccttaacgcaagaatgaagtagaaataaactgacttagggaacagcataaaaaagttctcttatgagtcaagatttcagtgtgatgtcatcattttttccagggattaaatgttagaatatattgcatgcccatattgaggtggaatcataaacttatttcagacttattataatggctcattttcttatgccttcaccattgaacttgtacttagctggggattgagctgaaagtttgccttttctgtatctagcatagttgcaccaaatctgaccttaatcccaaattttcctctctgtaatatcttgtttccaaatgaggctcacattgaattttctcttgttagaaatataactggcaacaccaatcaaaaccattcattccattcagttgcctgtgaacaagcttgatttgctttgttattaatacagcttcttgtggtttaagtagaaagctcttttgtaaatatccctcagtttaagtatatatggtttacatttccaggtaaactataaattatctgagaaaggcccagcacggtggttcaagcctataatcccagctctttgggagtctgagatgggtggatcactggaggtcaggagtttcagaccagcctggccaatgtggtgaaaccccatctctaccaaaaatacaaaaattagccaggcatggtggtgcacgcctgtaatctcagctactcaggaggccaaggcaagtgattaaacccaggaggtggaggttgcagtgagctgagatcgcaccactgcactccagcctgggtgacaagctggactctgtctcaaaaaaaaaaaaaaaaaattctgtgaaaagatctgtgatttccattctcctttatagtaattgttaagcactcacaattagatggttataacaactatcaaagaaaaacaattattttaataaatatttttcaacattttctcctttctaagccctatgctatgcactaaaaactgcagagaaaatcaacacattctctacctcacagcagatttcttggagagagataggggtggggaggggaataagggttgctaaatgttgtcaactttgtaatacaactctcaaagggagatagttattagggaggcaaagtgctcaggctcagatttcaggttgcctagatttgaattctgtcttcactgcttcttttatgatttgcccaaattacttaagctctttaaaccacagtttcctcatccttaagatagggataataaatagaacttatctcataaaattactgtgaggattataagtgattatgaagttgattaaatttccccagtgcttcatacaaagaaaggactcaaaggatatgctagttcatagtaggggcatagaagaagatatcccttctctcctgggatatagggtatacttaactgtccactataaaattgaagataggctagagaaaagctaaaaatgaagaatctaataactctttagccaagagaaaatgaaacatgagggaaagggagaagttccaaatgaggtccacatttgtcgtgggccactgaatggtggtgccattcaggcagaggaaacccagaaggaggagtcattctgtagttagagggcacttaatgagataatattagagataactgaggttgagttgttggtacatatctgggtgcaaagtctccataggtccggaattttgaatagttttctggagtcatctggttattgttaaagccaagagaattggtgagatcacagaatacaataatgatcaataagagggaagggaagagagccaagaatgggagactgggaagcatacacatttaattaaggtttggtaaggtgaaaggtgtcagcagagaatgtaaaggtgaaataatgagagaaaaaggaggacatcaaggagaaagtcgtgttttgaaaaaaacagaaaggacacattttcaagaaagacattgtcaatagtttaaatgtcacaaaatagtagagtataatgcaattaaaaaaacaaaatctgttgcttttgttaattaaataactagtaacctcggctgcagcagtttcagtagagtgaggagagttgacaccaaactgcaccagtggagtgaaaataagtgggaagaaagagtgaggaagtggaggacagtcttttttttttttttaataaaatattttcccaaactgtcttttctggaacttccaacatgtctgcttaagagcttgtctaagttgaattcattcgaacttcttgaacctaattagtttctttttgctgttttttttttttttttttttttttttttgagatggagccttgctctatcacccaggctggagttcaatggtgcaatttcggctcactgcaacctcctcctcctgggttcaagcagttctcctgcctcagcccaattagttttaaagacgctgcatatattggcagggaaaacctagaacacaaagtcaaacttccaattatctcccttcagtgctcaaatcaagagttcatttgttgcaaggaatgggggtctggactccagggagaagaatagagttttagaaggagagttatcctaaaactaaatggaaggagggttctttgagataccaaggatttgcaggactttatttacaattaaatgttagtttcagacagcccaggaggaataggtctattaaaagaaagcaagagtagttggcataaggaaacaatttgcattggagcctgagagtgagtatagtaatgaccacatgagagacccatttgactcaagtacttcaaagcattgccagtgttagtctttgctccacaatcaagtggggaaaaagtgaaatgtctttgaagagcatttcctgtaggtggcctttgaggaggtcctgaaaattccaaacctgcaagtattaatggcaaagaataaaaatttctttatgtaaaatacttttaaaaatctttctaaatagcaagacattatatattaccattgttaaaagataaacgaattgagaaatatcattagaattatatgcagcagataaaatggtcactttttcttttgagacggagtctcgctctgtcgccaggctggagcacagtggcatgatcttggctcattacaacctccaactccctggttcaagtgattcttctgcctcagcctcccgagtagctgggattacaggcacgtgccaccaccccagccaatttttgtatttttagcagagacggggtttcaccatgttgggcaggatggtcttgatctcctgaccttgtgatccacccgccttggcctcccaaagtgttgggattacaggcgtgagccactgcgcccagccaaaaggtcactttttaaacttaaaaattattaagaaaacagtgaaaacttaatgtttaaaagagtagaagatagggaaaattattacacagaaaaagataaacaacagagaaagataaataaattgccagtgaatatgtaaaaagttgctcagcaccagtggtagttcaaatccaaatagcactgagttagcatttgttaactaataaattggcaaaaattatattttgataaaacccagtgttgttgacatcccaagaaaaagggctatgctcacacagccttggagcatgtgcacattgatgatttttttggcataaaaattagtggtttctattaaaatcagcagtgtaattcacaatcgctaagacatggaatcaacctaggtgcccatcaactgtggattggataaagaaaatatggtacatatatgtcatggaatactttgcagccataaaaaagaataaaatcatgtcctttacagcaacatggatgcaactcgatgccattatgctaagcgaattaacacaggaatagaaaaccaaataccacatattctcacttataagcaggagctaaacattgagtacacgtggacacaaagatgggaacaatagaaactggggactactcgagggtagaaggagggagggggtaaaggttgaaaaacaactactatgcctagtacctgagtgatcggatcaatcatgccgcaaacctcagcattacacaacatacccatgtaacaaacctgcacatgtacccactgtatctaaaatcaaaagttgaaattataaaaaataaaaaaataaaatcaacaatgtatatttctctcacacagccatcacgatgatgtatttggaataatatatgcataaggatgttcattgcagtgttgtctgcaaggacaaagtgaaaacaatctgaataaccaacaatatgacacagagtaagtaattattggtacgtctgtacaatgcctcatgcaatcaccactgacagcatgggaaagagagacatctattatgaaaagaccactaagacatatgattacatgataagtgcaaggttcatgaataaatagtatgtatactagtatagcatacttctttctaagaaagaaactataacacatacaagaatggacaagaagttattaacaatagctaactttggtgataagactgtaggttgtaaaaagccagactttcatttctcattttaaacccaatgaattatttaaatctaaccctactgcattcattatctttacaataaaataaatatgtataacaatgaaacatagtttttaagtatttgggacataaattaaacattaatagattacacctcttaaacttggtactttagtatcccatttctctgtgagaactctgaaagcttcatcttccacagtttaggtaattctttggtgtcttattttgttattttcttgccctgagattagcaatgtcagatctccaaactgctaactcttctctttggcagatcaaatgcttcttcttaaaaaaattaagtttttggtgtcgggagcgcgcggcgccccggctcccgcccgctcccagccgggcccctcagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagtggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccaccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccacgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccattttttggtgtgtttatggaagtgcatgtagagcatcctgccctttgaaatcagactgggtgtgtgtcttccctggacatcactgcctctccaggtcattctcaggcccgggggtctccttccctcaggcagctccagtggtgggttctgaagggtgctttcaaaacagggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggttggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagactcttgagaaattgttactcattgaactggagcatcaagacatctcatggaaatggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaataatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtctgtggttcagagtaaacttgaagcagatctctgcatgcttttcctctgcaacaattggctcatttctcttttttgttctcttttgataggatcctgtttcctatgtgtgcaaaataaaaataaatttgggcaaaaaaaaaaaaaaattaagtttttaaaatgtatttcataggatttttgttctctctctccctctttttgtgcatatgtgtgtgtgtctgattagtctttactatcttaaaatggttagtcctgatagacctgtttcttcaaaatttctctcagttctttggcagtttgctcttagcttataattaaagatcaatttctgacttgtcttgttctagaaaacctcaatggaaattacagcaagctgaataggatattaattaaaaacataaacctggtgaaacccgaacatagaggctccagttcaaagatgcttccaatagttgacatggcccttcattccttaaaaccagctatttttcttttgaattacattacctttaattctgtaaattggatgttatatagtaccatgaaaactgctgtgagtaattataatactcattgctgagtgatgtgacttctttctcaaggctatttctgagggaaattgtacaattagatctttaggtattgtgacttgttttggaaatcatggtggccctccagggagctaatgaatctttaattatttagaggttcacatgagaccccttacagatataagcacattagctctgtagctaagggaacatttaaaaacagtaacatgaaatgtgtcagacatagaggaaagatgaagaagcaagtagaagctaatgcaaacagaggaactgccagctctctgtggcactctagctctctctgtcagtatttggttggcaatgtagacatagtggatgagtgcaattacatatgttaggctcattctgaaatgcaggagcattttagattttcatgtagaagcctgacaagcaaactacatctaggatatactttgataactttgagttgagagccaaattttttgaaggtaaaccatctccctgttttaaagtagtgtttaaaattataaaaattttaatacatctgtaatataaaatatttagatataaatactacaagtgcaaatgaatttttttttctacttctgcattcaacttttctcttctcccttcagggaaaacacttttgtgtaaaggcctccaaaatatatgtagaggtgtatgtatgttaaaaacatgtatacatataatgcataaccaaacaaatgaaatatcctaaacatatggacctgaaaattgcttataataaatttgaactgaacatataggcataaatgtggttcagaagtgtccagttgaagcaacttcactttgttaggtcaacaaaagttggggacaccaagatctactcctctgattttgttctagcattatcttaatggaaatgtttactgaaatggaaatacatgtagtggacatcgtggtggtgtctcaagcattcagtgttccctgctctcacacactcctaaccaaataatgaatttctcagcttcacaatgtttaagtgacatgagtcccatgcccaattcttggtcattgtaattggtgcatggaaggaacctgtgccttctgctaatcaaatcagaatgaagtacaactttttcattccatgattgaagagggaaatgccttctttccaaatgcagcagaggaagcatgaggtactaggattggaagttgtctactcatgacatgatattttaagccatagaataaaactgagacctaatgtgttagtcctttcaggtcgctataccagaatatcacagcctggatggtttatgaacaacataaatttatttcttacagttctagaggccaggaagtccaagatcaaggtgtcaacagattcagggtctaatgaggatttgtttcctggttcacagacagctgtctttttgctgtgtcctcacatggtggaaggggcaaggaagttctctaaggtctcttttataagggcactaatcccattcatgagggctctgtcctcatgacctaatcaccccccgaagacccactgccaaatatcatcacactagggattagatttaaacatacaaattttgggggggatacaaacattcaatctatatcacttaaggtagagtgaagaaacagggaggacaagaagcatttattttgtgtcattattaaacttctgcattaggctatcttgagcctatactattgttcaaaatctctttattatacaagccattttgaattttgattgtttgcaaccaaaattaacctaataagttaaaatgtactataatgttacatcataatttgtctgtactagtagtatttgctagagtgtttaggggaatacttgcttgttaactttttagtaaatataacactccatgttcaaatacatttgggaaatgctgagcatttcacacttttagagactcaaaacaggcagcacatttttaaaaaataaaaataaaaccaaatagcattgcatttggagaatggtacaaaaaaagagaatttgataaaccagagttatcagaactcagtggatactatgtgttagacattattataagccattaaacattttacaagcttgatacctgagttaaaaattaataacccaaagacacattggaagagaaaagttgacatatttttattatattaatgacctaaagatatcatagcaactaacctcattatagtcaacaagtgaatgaacgtaaataatattaaataactattggaaagtctctctgattaagcatggaaataaataggcagtgcttttgaccaataaatggaggacttacaatattttccaatacgaaacaaaaagattctaaatgtaaaggttttaggcccaaaatatgttagtcaattcatgacagcagaaattcagcaggtcatatttttggggtaatgtaaatgacaatagaaatcatggactaaagtgtaacaaataagtaatatctaggcaggtggaaattttaagatcttttaaattaacttctggactatagcaaaaattcaaactaaaattcatcagggagtcagggaaggtcaaatgaagaagcatggggattgaggcaaaaaccctgaattataccaatattatctttttttttattatttttattttgagagaggatcttgctctgttacccaggctggagtgcagtggtgcaatcatagttcactgcaaccgcgacctcctaggctcaagagatcctcccacctcagcctcttgagtatctgggactacagaccctcatcaccacaacacccgtctaatttatctattttttgtaaagatgaggtctcactttgttgctcaggctgacaagtattatcttaatgttatagaagaaaagtaattctggccatatataggtattattctttgcagtggaatatcatttcagaaatttgtgccaaacataaaattagttttctagtagtaaaaagtaattaaactctttaaattattattacccctagtatactggggaatgagtgtgtgttccaaatgaaaaaaacttgggatgtctaatgagatgctgttttctgtcgcagaaaatctatgtaaaatgttttttctcacgtgtacactgttgatatttgagacagcacatgttaacacttcaagaagtaaaataaatgtgttgattatatccacagttttcatatttattaactatatattttgtttttaatgtaatgcctattgaaaaacctgtaaatagttgtttcttaaaattgataaatactgcctaagatttttctgtatattttcatatttcaattttcctgtgaggttagaatgaacacttttagctaagacatttgggcctccaaatcctaaacctttcagaatgttagtttattatttggtttttacctaaattattttctgcttattcaagatccttaggtctatccagttacgtttttatttttttatttttatttttttattttgaaacaaagtctcactctgttgccaaagctggagtgcattggcatgatctgggctcactgcaacctctgcctcccaggttcaagtgattctcctgcctcaacctcccgagtagctgggattacaggggcataccaccacacccagctaatttttgcatttttagtagagatggggtttcaccatgctggccaggctggtctcaaactcctgacttcaggtgatctgcccacctcaggatcccaaagtgctgggattataggcgtgagccaccatgcctggctgtatccagttacatttttaagaccagccaggcttaatatatatttggtctttagctcaattcaatttgttgcattttgtccattgtacttcatgtgacacagaatatatcttaatttaaaaagacatatgtttgttgagctatctgttacgttggtatatcttggaattttaaaaaatataaaccacagaagccaattatggctgacattaacaataaataggtttatcacagaaatagtggggaacttgtagaactgttgagaaggctagagagccagatcaaagctaggcagccaggaaatgtaccccaaaccatgctgtagaactcatccagggaggaaaccactgtcaccaccagtaagaagtaacaccgaagatgcagagagcaacaattgcagcaattgctcaatcctaggctaactgcaaagccaccagcaccactcccacttgttcgctttgcaacagatagctgcaaaggaggctgagaaagcaagcatttgacattttagcttctaaagcaggaggtggtttcttgttttcgtcaaaactgagaggctgaggaattcctcaaacacaggaacaaacatcaaatagtaaatattcatgctttaacttgctcaatatcaatataaactttcccttttgaaagtaaacacgaaagacccaagcttccttctaacagagtgcaactatttctctaataattgaacatgtacctacaatctcttgaacaatgaaacaataaaaaattctcaatcacagcatgtactctaagtctaagaattctgggttatgtccattcctctacaaagttcttcactatactctcttgacattctgccatatatcatttaaaaattaagttaatcaccctcaataagccctgttttaaaaagagggataaatggagaggaaagaaggaaagttgttaagatacataagtatgcacaggacaatacaagagaaacaatgtgtttggatgtaaaggctctcctttctgcaagtggccagcaggtcactattggcatctatggccatgtgccctcagctaacacctctgctagtcagggttttgccttgtgaaatgaccaaatattcattcctgacagagaaatgtccttgataatctttttgtgtgagcgtgccatggtcattgttaatttctttcatttaacaaaataatagactttattttttgagcagttttagctttatggaaagatcgagcagaaagtacagagttctcacatactgtcacctttatcccacccccagtttacattagagttcactctttgtgtggtacaggtctaggagttttgcaaaacgcataatgtcatgtacccatcattacattattaccaacgtattttcaatcccctaaaaatcgcctgtttcagaactatttatctccctacccatccccaaactcctggcaaccactgagcttttttgttgttgttgttgttacttagtttttatttcataatcataaacttaactcaactctgcaatccagctaggcatggaagggaacaaggaaaacatggaacccaaagggaactgcagcaagagcacaaagattctaggatattgcaagcaaatgtggtggaggggtgctctcctgagctacagaaggaatgggtctggtggtgaaaataaaacacaagtcaaactcattagaattgtccacagtcagcaatggtgatcttcttgctggtcttgctattcctgtacccaaagtgctccgtggcttccacaatattcacacgttctttcaccttgccaaacgccacatgcttgccatccaaccactcagtcttggcagcgcagatgaaaaactgggaaccatttgtgttgggtccagcatttgccatggacaagatgccagaacctgtatgctttcggatgaggttctcatcatcaaatttctccccatagatggacttgtcaccggtgccattagggcgtgtgaagtcaccaccctgacacataaaccctggaataattctgtgaaagcaggaacccttataacgaaatcctttctctccagtgctcagagcacgaaagttttctgctgtctttggaatcttgtctgcaaacagtttgatggagatgcggcccaagggcttgccatccctggtgatttcaaaaaagacgacggagttgaccatggctgatagtacagggctcacagcgatggtggcgtctgcaaagataaccactgatcttttcactgtctttatagtttggccttttccagagtgttgtatagttgaaatcacagtatgtacccttttcagactggcttctttcacttagcaaaatgtctttgtttttctgtatctttttgtggcttgatagttttttccttttagcactgaataatattccactgtaggaatataccacattttgcttatgcagtcacctattgaaggacatcttggttgcttccaagttgtggcagtcttcatttctttctttctttctttctttctttctttctttctttctttctttctttctttctttcttcttctttttttttttttttttttgagacagagtcttgctctgtcacccaggctggagtgaagtggcacaatctcagctcattgcaacctccgcctcccaggttcaagtgattctcttcctcagcctctggagtagctgggattacaggtgtgcaccaccacgcctggttagtcttcaggaatatttacaggactgtatagaattaggagccatcaaaggggatccctgaattctttctgtttttcttacaaataccagttttaaggtcaagatttactaccccatgccacagtgtagccgcattttaaattttaaatttttgactgtttgtttaaaggtctcaggcaacctaaaaggctagatagaagtctctcatcctctaacgaaggatggattgtaaaatggaatactgctaagactctccctttgggtactaattctgcaaaaacctagaatctcagagacaagagacaagtatttggagtggatcattagatgtaatgacaaaaggagtcacttcaacattcataacaaatatcaaagattgttgtattttttatataggagacaccagacaagcttatacttagttactagttcagaggatacaccaccacatcctctagcatgagtacaaccttataagccattgtctccagctggcactgtgattgagtctttaataaaatattcaccattctgtaataataataattttggttagtgataggataaatggtggaccaggtgagtccaatgaatatctactcatttgttatacaacaagttcttttaagagaaggatgtagaacaggatattatggcagtatatataaggcattcaatgtacccgtggagagtggcgatcagagaaaaatgatgtcaggtaaagcaaatgtaattcaaggttaaaggtagattccatttacaaaattccttgttgcctttatcatagaggagttccaataaaatcaacaagtctgacaaaaggtgactggtttattcacccaggatatgttattgtgtgcttagccttggactttgttgcttgtgtgttggacacctaatagtcttgacagctaaataggcttttgtaagcgagagtggtaaagtccaacatgttgctgaacctatgtgtattctctactgctaccaccaatgttgctgtttattagccttctaagcaagcaatgtagtgcctggtgaaagagattgtttcataccttcatatctatttgataaccttcctgatgatagtttggtgagcattcgtattaagcacaaatattcttacactctggctcattttctgtggttcatctacatattttttccccaaaactcattgccaccaatccttcagtctttgtctttccgagtccctaattatcttttcttttctttttttttttttttttttgagacagagtttcgctttgttgcccaggctggagtgcagtggtgcaatcttggttcactgcaacttcttcctcctggattcaagagattctcctgcctcagcctcccaagtagctaggattgcaggcacacaccaccacatctggctaatttttgtatttttagtagagacggagtttcaccatgtcagccaggctggtttcgaactcctgacctcagacaatccacctgtcctgtcctccaaaagttctgggattacaggtgtgagccatcaggcctggccccaagtccctaattatctagacaaattattagctgccacatatacatcaataatatctctccttctagacatcgtggacaaccaattacataggctgaatttcttttaaaattgcattcacgtaggttataatgcctaagcaatctacttttggctgctgctgtgatgttgtacagtgacttctgtaaatcaggctcaatttttccctcactaatcaactggccatagagaacttcccatgaagacataggtatagattctattattcctacctgctgatgaagcaggatagttaattggaaaacacttatttcatgataagcagctcatgttgtcatatttttttgcattgataggacttcagtttctacaatggtccaggatcaatcaagagttctttaaagaaaacatttattttgtcaaagaaatgcattttgttccaaatcctaagaacaatagtagtggtgtgtcagaggctctattgcatctggatataaaaacaaaggggcacaatattcctgaccagttgggaattattatcttcatctcaatcccatcaaaatgtggcagcatgacaagtcatgaagtaaaaggaccaggtgataaaatgaggtctccaaaatccaaagcatcaaagttctcagttagtggtcagggctgcaaagtgccataattttgcactttggaaggtatatcttgagaatattgagtgtatgagacaagttaaaaggtcatgcagccagacgcggtggctcacgcctgtaatcccagcacttagggaagctgaggtgggcggatcatgagatcaggagttcaagaccagcctggccaatatggtgaaaccacatctctactaaaaatacaaaaattagtggggcatcgtggtgccctcctgcagtcccagctacttgggaggctgaggcagcagaatcgcttgaaccctgaaggcgaaggttgcagtgagctgagttggcgtgactgcatccagccttggcaacactgcgagactctgtctcttaaaaaaactaaaaaaataaaaataaaaaaaatttaaaagttcgtgattaacacctctgttagcctctgatctttataataattatcacacacacacaaaccaaacaccacacatagaggaaacagtaaaagattaaaggacacagctaaaaatacatttgtattattacttcccaaagttctaaaattatcagaagggactagtgaatctttaaaaaatattgattatccaacactttttaataaccagtataattgcattgaaggctactgaacatgcacatgttcctaaaatttttctgttatggtgtctggtttgcgaaaggaacaaaattaaacatagttccttggcaatttttccctcttccactctactaattggcgtatgtgcgatgtgtgtttattgtaaaataggaataagattcagaggtcaagaatcaaagtgagtcagagtaggaaaagccagactcaagcataacagaagggcagagcctgtcaaaccccaaaattaaagggtaaatttcaacacaagtagaagtggttcaaaagctaagggcatcctcatagttcatgaaaaacaagtattcacgcaggtagcagactctaatctgcttcaagccaatgtgctattctcttcgtgttatttatatccctcagaatacctcaaagttcccaagagcagtcagtatttaactctaaactatatcatctatatgatatatttattatatataatatatatatttattatttgtataatacatattatatatttattatatattatatttatattgattatatataatatatatatatttattattatatatttttttgagacggagttttgcttttgttgcccaggctggagtgcaatggcgctatctcggctcaccacaacctctgcctcccaggttcaagtgattctcctgcctcagcgtcctgagtagctgggattacaggcatgtgccaccacgcctggttaattttgtatttttaatagagaaggggtttctccatgttagtcaggctggtattgaactcccatcctcaggtgatctgcctgcctcggcctcccaaagtgctgggattataggtgtgagccaacgtgcccagccaactatgtaatattttaattgtgtagtgataaccctcatcaaaagaagtattcattatggtcagtgtactctgcttatttaccactgaagcttaacacaaaattgttgaaataaacatgcatattgaagtacttagctagctattgaggcaatacaggtttctagatttactcatttttttcactgtacacacatgtcgtgtgtgtcatgataaacccatgtgtgtgcatatattgattaaatattatatttctttttacttttattattattattgagaaaagatctcactctgtcgcccaggctggagtgcagcggcacaatctcggctgcctgcagccttgtcctcccaaagccctagaccctgtaacataatggaatatgtatgtttctaatttgtgcaatatggaagcaggaatactacatagaactgtcatcttttcctattgcatttattttggtgtggaaaaatataataattggcttcagtcagtaagtctatttcattcaagaatatttaaatataatccaaaccatcttaggtacattttgtgatacaagaggatggtatcttctatttggaaatataaaatcccagggtctcacagtttaagtatactttccatgggtatgtataaaacaagaatcccactttacaaagttaatagaaaaaatatatgctaattggaaggagaggcttctgattgaggataaagtggaaattttcacatactgctaattacactttaatggagtaagaaaaaaagaattggaaatagtaccctataaaacttctgaaatgaaattacagtttctctctctctcttttttttttttttttcttgagacggagtttcgctcttgttgcccaggcgagagtgcaatggcgctatctcagcacactgcaaccttcacctcccgggtttaagtgattcttttgcctcagcctcccaagtagctgggattacaggcatgcaccaccatgcccagctaattttttgtatttttagtgacccaccacgcctggctgtctcctctttttagaattaggagaactgatttttttcagtgctaaactggcactgtcctatgttttcaagaaagcaatatggtgaaacgaaagagcctggatagcatgttttgttagctggcgtctagttctttaagttccatgagtctattgtgtcttctttacatctcaaaaagaagagagaagaaacctgcatctaattactgaagcagtttcattcagcaaatgtaattgcatcgcaggcacatctcaaattaaaaatcttcatcttggtctctgtcatttccattttaaactgggactgaataacctgttttaccactcaaaataatagccagtgtctctttcttattaaaatatgtgatcttttgcttgattacctaattatgtcacctgcaccttacatgaggcagatagaagagtcttccagtctgccagagcagatctaccaaactagactgcacatacaaattacctggggatcctgataaattacagattctgagtctgctttcaaacagggcctcaagtcaagctgatggtattagtcccaggatccctcactgagtagcaaggtcttacaattaaaaagtgtgcaagtataaggccgggagcagtggctcatgcctgtaatcccagcactttgggaggccaaggcgggtggatcacctgaggtcaggagttcgagaccagcctggccaacatggtgaaaccccgtctctactaaaaatacaaaaaaattagccaggtgtggtggcacgcacctgtaatcccagctactcagaaggctgaggcagaagaattgcttgaacctgggaggtggaggttgcagtgagtcaagatcacgccactacactccagcctgggctccagcctgggcaacaacagcaaaactccataaaaaaaaaaaaaaagtgcaagtttataaacatggaaacgtggacaattgtaagcaatattagagaactgtagaaaacaattttttaagtgatatgtttaacctatttagaataaaacccattatggtcctaggaatttctggaactgccttacttgtgagaaacatgatcctaagatgcccatttgtttatcagtacatcaattttctccttcttgaattggtatcattattttcttccaagaagcctagcacacttttgttgttgtcattgaaagagggcatataagggttatggctgctatttggagaaatgcattagaaaataaaaagcttgaaaaagttgtattactgagaaaaaagttgaatgaaaataagaaagattaaattgaaataaataatgaatcagtaaggtatgcactgttaaacacttgatgggatttcccaagtatcgacatgctgataacttgaaataagaatgggagaaaaggtcaatctgaattcttaaaatgttgaaggctgggaataagaagtaatatatcacagaatctgatagaaaaatttttatttattttatgggagaaatgggagactaacagacaataggaataggaaagaattaatagaaatagcaaaaagaagtgtatctgcaattattaatataatacaagaggacattgtgtagagatatttaaagaaagattgatgaaatttagatttatggagaaatatcctaataaagacattatttataatcaactgttcatcattattatataattctgacagtttttaggttataaatgtaaggcagaatgatctaatataaaatgtataaatgggacaacatataattttgcttaggaagttgaataaataaagtagtgatttacaatttgcattaatataaaaaaatttaaaaaatggtttacattttgtttgaaatggatgataaacaggaaaagagtaatttagtacattgagtaatttagtacattggtcaccaaagaaatacaaattgaaactataagatgccttctcccatctttgtcagatttgtaggtataaaaacagtagtagttgtattcgttggagaacagaaagatgacactttcatatgcggctgattagagcacagattggtatattatttctgagatgcaatttgaaaatatgtaccatcagcctcaaagatgattatgaccatgtgtcactactttcttggaaatcattattaatgcatgtatagattgatgtttactgtagtattacttaacataatgagttgagtacaaccttcactcccaaaaaacatgaggtaggggtgaactagttaaatatacaatcacaatgagctatgacaaaatgcagttacttaaaagcacatttataaaactattaatggcaataaacatgatttaatataatgttttcaaaaattaggggaattctattcccagcattgtggtagactaaatttgctgaatcactatgctgctatatgaaatctacaaataccagataaaatgtacatgtcatttttcaaaagtatattactgacttgaatagaaactaaggtgaaccacataggccaagcataaggagaatacataaatccagagaggtatgcagacccccaaaccagaagcttccataaggacagtcctggtcctagtaccctgagcttcaatttttatgaccacctgggatatgggagagtgtgagacaaaacctagtgcctgcccagtatagcagtcttacaggagaaaactgctgaaagccacagatacgaaggactataatttcagggaaaggataaactagataaaaacctgttcctcagggggagacaaccaggaaattttcctgcctcaaactcggtgctatttagaggaaaaatgagaaggccatcttcacatgaatttgtggtttaaattttcactgtaagtataagttaaaaaaaacccacacatgaaactgataatttattttatagttatcccatgttggtattaccaccaaacacaagacgaaggcaaagtgtctttggagaaacccacattcagcccatgtctcaaagaatggccacaggtaaaatttcatccaaaatgagaaaaaagtaagactcttacaaaactcatgaggaaataaacatcatgagcagaaacagaattatgcccataaagatttcagatattaggacgattatataactataaaagctgtgtttaatatgtttaaaaaatcaatgaggtgtgccaggaatataaattgagacagtgtatgtatcttatattaagcagattgaaactgaatttaagagatcttttagaaataaaaaatataatgaaaattaaaaactaaatggacaggttaaacacaatattggatagaaccaaaaagaaaataagtgagttggaagttagactaaacaaattatgctgaagacagtacagaggaggaaaggaaaatggatatgtgaaatagaggttgaaaaattagagtatctaatcatatctgcaaaagaaaaattgaattgagggaaggttatatttaaggttatatttaatatctgagggcttttcgtcattggaatttattaatgttcaaggaaacctggaaagttttctaacacattaaaggagctttaattataagttccaaattcttcttagaagaagagaaccagcaggcccagacatttttactggtgagttctatcaaatgttttcaagaaatggattatttccattttataaaaacaactccagaataaaaaaaggtccatttgttcgttcattttatgaggccagtacaaccttgataccaatgttatatgagaaatgtgtaagacaggaaaattacatgccaactttcctcatgaacctaacggcaaacattttaaattaaaagttagcaaattaagtttagaagtctataaaaaatatagtatgaaaattgtgtttgttccatgaatgcaaggatttctaacaatagaaaaaaaaaactatgtataattcatcacattaacaagttaaaggaggaaaagcaaatcatcattgtaggagaggcaaaaagtgaattcaataaaataaaatatttaactttgacaaatcttgtttagcaaacaagaaatagaagagctttcagtgtttgcttataaatcagaaactattcttcgtctttcaagcagaggtgatttaatacaggtgattgattacacaagtgatggaagccaaaccaggcttggtgagtcagcagcccatatttaatatatttatatattaaatatttaattatacttcaaaacttttatgtacactataatctcattattgttttctatactattatatgcaatatacaaatacagaaatacagaaatgtacctcagtttgaaagagaatttgaatatgaggcaaaaagatacccccaaattatagttacattacaagaattgaatttaagaaggaagaagcaaattgcaagagataaggccaagcctctttagtaatgatcattctaaatccaattggtataaatttaggaacgcacaactggattgcagtgtaactaagaaagtttgtgtgtcaataaccatatttatcctatgtgaagaaataatagtttcataggagaaggttaattggcatggagtctgtaaaagagaagtttggatagatgattgagctatgtatttgtcaaataatatctaaaggtaaaaagagatctagttcacagaggcgaatctctgattttttaatttgcattaacagaaacaacattggaagggagtatattaagattttaatagtgactatttctgccaatggtttctgttttattgtttactatttttggtatatttccaatgtttcttaataagtgtttattatttaaaaaatgagaaaacagcaatgagtaattcagtaaaataacatttttcaaaattgtgactgctatgattatgagccaattatgaaagaaagagacacagatagaaatagggtgaccaatctttcaacttactcaggaatgaaggattttctggatgggggatttttgttgctaaaatcgggacagtaggggacatattgggactgtggaaaaaccctacagggatttatttcctaactatgaatttctatcttggtctagagacgactgttctcataaataggtagaatagatgtggtatttctggaatgagatttaacatctttacgtagcttgccctattaaaagtagacaaatgcttgtgagagaatatcatatacttttgaaagctaatgtcttaactaattcgctgtgagcaaagctcttgaagactgtgatgtaacagagattcctaggtatcagtgaagatacggagatgaaaaagggaagttgaaaaaagaagctgagagataagcatggaaatcattttccaaactcatttttccaatctccattttcctgtattgagaagtgaaaatatgttttctagagataaagttctagaaatgaactctgacatagatattttaaaacccatttcagaaacaaaataatatgtgaacctagagtagttgtaatttatgtccttttgtctgtctttatcctgtagttaagtttcccttgggatctctttgggaaaatggagtactgcattttacaaggcaggacttgaattttcgttcttttccttctttctctctctctttctttctttccttttcttctttcttctttctctctttttctttctttcttcctttctttccttcctttttcttttctttctttctctctttctttcttcctctctctctttttctcttctttctttctttctttgttcctttcttctttctttcttcttttccttccttccttccttccttccttcctcttcttcctttctttctcctttcttttttttttttttttgacatgatctcactttgtcacccaggctagagtgcagtgatgtgatcatagcttaatgcagcctctctctcctgggctcaagcaaacctcccacctcagcttccagagtacctggggctacagctgcgtgccaccatgcccagctaaaggacttgaattttcttacatatcttggccctatagagtggttctcaacctcggctgcacatgtctattacctgagaaaagttttaaataacctaatactcaggtcacaccctagactttaggggtgagacaagcattaatatttttttaacactcttagaattaagagccactaatattgtagcactgcaattcctataaagagaacagatgtgagtcgatttgttacagtattgttgtattcatctgttttcatgctgctgataaagacatacctgagaccaggcaatttacaaaagaaagaggtttaatggacttacagttccacatgggtggggaggcctcacaatcatggtggaggacaaagaggagcaagtcacatcttacatggatggcagcaggcaaagagacagcttgtgcagggaaactcccattttaaaaatgatcagatctcatgagacttactcactaacacaagaacagcacaggaaagacccatcctcatgattcagttatctcccactgggcccctcccacaacatgtgggaattatgggagctacaagatgagattgggtgtggacacagccaaaccatatcaattgtcatcactcaaggcagatgagtatatagaaagctatcagttgtaaggaattggactaagtttaagagaataataattaagatagaacaaatgtttggtcctgcttaagggctaggatagatgaggcacaatagaatcatgtggggagctgtaaaaatgcccaggccctactctgtgtcaattaaatcagaatccagaatctctgcttgagtgtgtctagagtattggtcaaaggaaacagtgattttgatgtgcagccagttaagagctgatatcctcaaggatcatgatgtgacacagctgtttcagaagggtaaatctccatactcccactttagaagaaaagaaaaggcaaaatgacaaaacaatcaagcaaaagggctggaagagctggtagataacagggtgtcaacttgaattaattcagctctttggtaaagattagctggagtaaagaaattccagttagtcaaatgggatgaatgtccttttatggaaaccatatcatgctttttgaatgatctgagaaagactggaagcattagaggtgaagtatatccatttgctcaatgggagaagattttgttttattttatttacataatgtgatatgcttggccatctgcagtagtgcctgaaaggggatgtaaaacggaaaatgtagtcagtgagactgattaataaccatgggtagaaaaataggccaagtggaaaaacttattcatataattgcttcattttgctgactgcaaaaggatttgttttggaagtgatttctgctctttaacctagtggattgatagatcacagaaaggtcttagaaatgacattacgtaattttgttcataacatgaaattagcttgaatcaaaaaatgtatacctttttttgtatctaccttctaagacatttgtcttgagaaattaatgattctacaacataaatagtcattgtgaaaggaaggaaaaagataacagagggctttcataataatcatggactcaagattatctaatttaaaaagacatatctcattttcctttatttaaacataaaacaaatgagagaaaacagaaatagctcataattttatttgtctgataaaacatgctgacataaaaatataattcatgcacccagtaagaaaatcaaaaaattaaataaaggtaaaaatgaaatataaaattctctttcctctagtctcttacccccagacatctagaatctctccttaagataatcactgttgacaatttcttgagtatctttttaaaaatgaccttaatacacatcccccatatagaatatagctcttaaacaagttagaaaataaaattttatcttttagtattacacaaaaggatgttcagaactaggctttgtattttttttttctagagatgaggtctcaccgtgttgcccaggttggtctcaaactcctgggctcaagcaatcctcccgcctcagtctccaaaagtgttgtgattacaagcatgagatgaagtcttgcctggcctaggctttctatttttgtttaataatttaccttcaagatattcttaacttttaacaactgtattgtataaatatattttttatttaaacaataggctaccaataacattaataacatatcttggtttatgtattttacaagattctccatgtgataaattccaacctgagaagttgctatagaacatatgaatttaacattttttaattgctgtgatctaatatgatcctaaaacatggccctagtttatattcctatgagaatgtctaatacctacactcttgctaacattgactgctattgcattttaaagactcaataatttggttggattgatgttgaacatcttctgttattcctggccattgcatttctttttctacctattaatctcccttgtataatattgcattatttgtcttttttgtctcatttatcgacaaagattaaagttattggcagtagtgaaaatggagaaaaaaatcaaaattcaaatactgtagagtacaatattttggagaataatttgattctatatattgaaatttaaattgtctttaatctttgacccagttattctatttctagtaatttttctacccaaataataattcaggaagaaaacctttacagagattattcttataatgtttgtgatacaatatttacgggcaacataaattctcatccagagattggagtaaatattatatagtatatctgtagaatgaaatgtaccttgctgtttaaatgaataaattagttattatcataaaataaatgtcatgtaaagacatttattttatggtgtataaaattagaaaaacaagttattaacaaaacatgattttttgtaaaatgcttttattttgtttttaattgacataataattgcacatgtttatggggtacagtgtggtgctttagtgcatgtgtacattgtgtaatggtcaaatttaaaaattacatgtattgacagaaaaagtgtttggatatttgtatcctaaatgctaacagtgatgatatctggaatgtggaactgctggtaatttttccctttttcttttagagatttttgtacttatttttaataataaacatatactaattttataataaaaataacaatgaagtcctttccattttgaaaaattaattccaatagaaaaatactgtactcgagccactttccagggttttcttattcttagtgctggtataaggtaccagtgatattatattttcagatatgtttggcttttctgccttatggttgaagatgagcttaggaagtattgctgcctaattttcaggcttttgagccaatgcttggtgcacaaaaagcaccacatcaactttaaacagaatattctgcttctttagactgtatttcctactttttatagtatttattagcgccagaactctgtgactgtttgtttcccaaagaacaagagagaaagatcaaggaaattgagaagcaatgaaactagatttaattaatactctggcttgtcagcagctttcatgaaagatttgtttgttgaagaagttgaacctattagcttaaacagggattaactctgccaactctgacagagcatggacaattaagagtttattggaaattaattgaaaataatacagtgttgtgaggtgggatgaagatgatttcctttaaggaaattatgccaagtgttttgaatcagccaaggataaacaaatgcagactatcatttgatggaggtattataaactgataacatgattcgaagtataagaatggcaaattgtgaagaatgaataaaattacagagataaatagcaaaaatgtgaaactaaaataaagaggaacagtgagtaaatggggttagctgagaatatggtttaacagggcatactctattcatttatgaagaaattttaatcctcaaaatgctacttgtcttagtctgtgtaggctgctgtaacaaaataccacaagctgagtaacttataaacaacagaaatttcttacagttgtgcaggctgggaagtccaatattaaggcagattcagcatctggggtgaggttcacccttctggctcatagatggcaacttcctgctgtatccccatactttggaaggggccaatgagctctctgggatctcttttataagggcacaaatcccattcatgagaatcttgtcctcatgacctaatcacctccccaaggctctatctcctaacacgagtagcttgggggttaggatttcaatatacaaatttggggggacataaacagtcagtctgtgacattgccatttcatcagtaagaattttcatgaactcactattaagatttatgtttaggttttttatgcggatgttctcactttataatattgtttgtctgcatagtttaaagaaaaggacaatgcccaattagaacaggaggtgtcttttgttggccagcaaaatattttaagatgccttgagtgtgaccctacatagagatcatcaaggtaacatcattttgttcttgttctagatccacatgtttcactcaagatcccagaaagaaaatgtatgaaaacacattggaagacaataatccatccttacaatgctagccaatgtttattattgctttctatgtgtgaggaattgtgttaaacacttaaaaagatgttatccctcataattatcataacacctgaagaagtaggtggggtgattttctccaatttagatattataggaactgaaacacttgcccactaaacaggcaattgaaagagataggatttctatagaaaattgccagctccacagctagtgttcctattctcatcattagtgttcccttagtggttttgatattacacctaatactatttaatacaaaattaaagcatccaccctattctgggatttactgtcaagaatagagcactgagcctgataaacagtatccactttggaatgcatgtttctatccagctacttaatatgacataagttcattggacattaaggccagatttcttgacatgctttaccctcaaattaacaagtttggcttattcaattatggacctttaacccttaggccagatagtatatgaggcctagagtagtggaaaaaggtaactggatttacaaaatatgactcttcaaattctgtaagaattcaatatattgaggaacgtttaggtgcatagtaaaattataatttcatattgttgcacagactcaggcagatgaaagagactccaatagtggtcaggtagtacccagacagtcagttgattgtctctgtgctgaaaggatttaaagatgaagaagagtttgctccaatgtatgtttcaatatctcattgttttacaataatatttgaaataatacctaggaacccaacttacaagggatgtgaaggacctattcaaggagaactacaaaccactgctcaaggaaataaaagaggacacaaacaaatggaagaacattccatgctcatggataggaagaatcaatatcgtgaaaatggccatactgcccaaggtaatttatagattcaatgccatccacatcaagctaccaatgactttctttacagaattggaaaaaaactactttaaagttcatacggaaacaaaaaagagcccgcattgccaagtcaatcctaagtgaaaagaacaaagctggaggcatcacgctacctgacttcaaactagactacgaggctacagtaaccaaaacagcatggtagttgtaccaaaacagagatatagaccaatggaacagaacagagccctcagaaataacaccacacatctacaaccatctgatctttgacaaacctgacaaaagcaagaaatggggaaaggaatccctctttaataaatggtgctgggaaaactggctagccatatgtagagagctgaaactgggtcccttccttacaccttatacaaaaattaattcaagatggattaaagacttacatgttcgacctaaaaccataaaaaccctagaagaaaacctaggcaataccattcaggacacaggcatggcaaggacttcatgtctaaaacactgaaagcaatggcaataaaagccaaaattgacaaatgggatctaattaaactaaagagctcctacacagcaaaagaaactgccatcagcgtgaacaggcagcctacagaatgggagaacatttttgcaatctactcatctgacaaagggctaatatccagaatctacaatgaactcaaacaaatttacaagaaaaaacaaacaaccccaacaacaagtgggcgaagtatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttcacactgttggtgggactgtaaactggttaaatcattgtggaagacagtgtggtgattcctcaaggatctagaactagaaataccatttgacctagccatcccattactgggtatatacccaaaggattataaatcatgctgctataaagacacacgcacacgtatgtttattgcggcactattcacaatagcaaagacttggaaccaacccaaatgtccatcagtgatagactggattaagaaaatgtgacacatatacaccatggaatactatgcagccataaaaaaggatgagttcatgtcctttgtagggacatggatgaagctggaaaccatcattctcggcaaactatcacaaggacaaaaaaccaaacaccacatgttctcactcacaggtgggaattgaacaatgagaacacatggatacaggaaagggaacatcacacactggggcctgctctgtggtggggggctgggggagggatagcattaggagatatacctaatgtaaaagatgagttaatgggtgcagcacaccaacatggcacatgtatacatatgtaacaaacctgcacgttgtgcacatgtaccctagaacttaaagtataataaaaaaaattaaaatattctgcagtcacagtgactgtcttggcttctcttaatttatgaggacctttgtcttatagactcttttttttaaaaaaagatggggtcttgctatgttgtccatgctggagtgcagtggctattcacaggcttgatcattgcatactacagtctggaactcctggactcaagtctcccagtggctgggaatacaggtgagtgcctaccacacctagcctgatttacagatttttgacatctattatagttaaatgtattttcagcatttgcatattaaaggaataatattgatgcttaacttcattagtgatcagggaattccaaatttaaaaaaaattttttcatctcttatagtatatttaaaaattcattgctgataaggattcagggacgccaacattgtacattggtagtgaaaatgtaaattggaaactttctgtaatctgacagtaattatttttttaaaaatccttttgaacttgcagttctacttttgggatttgaatttatggaaagtaaagtgccagtgagaaagaatattgttgccccttgaacaacatagggttaggggagctggcctcccacacagtgaaaaatctgcatacaacttttgattccccccaaactactaataacctattgttgaccagaaggcttactgataacatgcgttacatttaagacatattttgcatgctatgtgtattatatactgtattcttacaataaactaagctacagaaaagaaattataatcaagaaaattgtaaggaagagaaaatatatgacccattcattaagtggaagtagatcatcttaaaggtcttcatcattgttgtgttcatgttgagtaggcagaggaggaggaggaggagctggtctttgtgtcttagggtagcagaggtggaagagggtgaagggatggaaggggaagcaaaagaggcaagcacacttggtgaaactttacaaaaatacatcattatttctgtctattttgctttttcatttctctaaaaacatttcagtgtagtacctatccgtcttccaccatttgctttagtttcagttcctgtatcatggaacggtctatgtcataaaagaagtcaaaagtagtcttgaataatcaaagcttttttgccagattgttgaatgccaatttgttttctggcactgcttttcctatgtcttcttcctcattatctggcactggttaggaagcactcatctccatgaagtcatcttttgttaattcctctggtgtggtgtgtattagctcttaaattcctccaagatccatatcttacaacccttcactccacacctttttttcccttcatatccatacttctttccatggttttctctaaattgggtttgtcgtaattctgtagctatgcacaacatctggacacaaattgtgcttttgtccagcaggaatttattgttttgagtttcatggttttctctatcaactgatgacatcttgaaaggtgtaagccttccagacttccatgatgttctctctattgggtttctcttttgcaatgttgacaaacctttccatagagtgccatatgtagagccttaaaggtccttatgactcccttatctagaggctgaagtagagatgtgtttgggggaaaaggagaacacttcagtgcctttggtgttgaactcatggggttctgggtggccagggggcattttccaattaaacaacaacaacaaaaaactttaaaaagcagtcccttactggcaaggtacttctgacttcagggacaaagcactgatggaactaatccagaaaaagcattctcatagtccaggccttcttgttgtacaaccaaaagactggcaactagtgtttctcttttccctttcaagactcaggggttagcagctttatagttaagggcagccctgatcataaacccgactacatttgcacaaagcagtagagttagcctatcccttcctgccttaaatcttggtgcttgcttctcttccttactaataaatgatctttgtggcttttatttttccccctggaatagggcactttcagctgcattaatacctattcaggcagatatcctttctcctcaatgtttttcttaacggcatttgagaattcacttgctggttcttggttggcagaagttgctactcccattatcctgacatttttaaaaccaaaccactttctaaaattatcaaatcatcctttgctgccattaaattctccagctttagatctttcaccttgcttttactttaagttgtcaaataatgacttcgctatttcttgaatcaaataagagtctataggtatgtctttcttatagcaattctgtaccccacataaaagctgcattttgaatatgagataagaaaggacaaggttttcatgcctgttggcacgaaatgaggccttatgaatttctctttttttttttaagggaccttacactggattcatttattttgaaatggcaggcagctgaagaactcaatctataggaagcaatctaactttttctcataatgtcacaacttttctctgcttcttgggagcactcccagcatcacttgtggcactttgtattggtctcatggtgttattcaagatttatagtattacactaagcacaatgaaaagagaactgtgagagaacacactatttacttagatacagaatttactgaagagaccaagtgctcatggcagatactggcaacatgagctctccacagtagcaacagggggtggctacaaaattattataatagtacatacactggaaagtagacgctggagaatattccaaaagatgccagggttggaggggagtgagggttgaaaaatgattattgggtacaatgttcactattggggtgatgagtacagtaaaacctcagacttcaccactagcaatatatccaaataacaaaacaatcatataataaaactatgcttgtacctagcacatttataaaaataaaataaaagtaattatttgggtagtacagtatgtgctatagttaattgtatgcagttgtggtttaatacagcatctttatgtttgtttatgtttctcttgactgcaaatagtgacttgtacggtttgtgtgcatacattttgataagttttaactttttataatagatttgtgtatattttatggtagtaaatgataaaatagattaatatatacatatactttatgcattcaggatgtacatagctttttcttaattttttttttatattctaggctatgcagttagtctgttagttttttcaattgcaattctccaaaactttttctgatatatttttttttttttaaataccagtgtaggcggacctgcacagttgaaacccatgttgttccaaggtcaactaaaaaatctgaaatctgaaatgcttcaaaattggaaacattttgagcactgatatgatgccacaggtgaaaaatttcacatatgacattatatgactggtcacagccaaaagacagtcaaaattttgtttcttgcacaaaattttacaaatacataaaattaccttcaggctacatgtatactatatgtagggaatgtaaataaatttagattgggtctcattcctaacatatcatgttatgatatgaaaatatttcaaaatttgaaaaaatccaaaatctacaatatttttggtcccaagcatttcatataagggataccatactccagaatgttagaatgtttatggctactttgtttgtagtacagggggaaaaaaaccatgatgagtctccatcagtaaaaagatagtttaaaaacttgtagaatttactcatatacatatatttacacatgcatatatgcacacatattatttttctctatatagagaaactgtgcattcatttaaagtgatatttcctctgttaattgacttggagaaatgttcatactgtgttgataagttggaaaatcagtttgtttacatgaggtgaagtggaaaagttaaactacattataaagtacattataggcttttcaaagggcaaaaaagtgtcacctgagatgaggcaatgaagtgctcatggccattcatccctgttttacaccaatagaaagaaaagtttggaaaatgatggatttctcaataaaatttcaaggaagtagaaataaatatgttactgtactaatgtattcatgtcttcttaagagaaatggaactccaaatttttagaatttttgaataggaatgatagaggaaagaaaacagaacactagtgactccggcattgtctgaagctgaggactgggctgtgggtaacccacaggtgatattactttagcctgaataatccagacgttatgatgttttggcctctgtgtccaagactcttgtagatttcttgtcaggccacaattctttgagtgagagtaatattttttcagtaggcaaaaatcccttgaaagatcaatccagggacatttataataagataggattagaaggtagactttaggctagggttagggttggaaaaatcaaaacacgttgttctctttagagtgagaaattggtttatcccagactttgaaggataatataatctataaccctctggttacgggaaagaagagacctacatgtggccatcttgggagcaaggcagagagcaggctggaagaccttctaggatggatatggacttgtgaaatgcagtagttaaaccaagttttctcagggttacatttgccttccatcattcctgaacactcatgtcatcatgaaattagaagagctgatccaatactattgataaggaaagagactctcctttccccaaagcgagagatagcagcaataatcagataatggcccagaagatggatgatcatacacacggcttgtgtgaggcttatggaagataaaacaaccacaatatttcagaaatgtttatatgttgtttacagttctaccactacaaagccttctagaatgtgagacagaatggtgtgatgattattctcagtataaccagattaagtaagatttcacaggtggagttaagaattaagaatttttgattcaagagtctcattcaccctcttccttctttgttaatagttctgttaggatctgcctttaatttgtcttttcctttagggcgctcaaaacaacacaaggattaaatgcctttctattgtcaaagttctctccttatttgccagttctttttttcatgtcccaatcataatcttaatggtatcgttgatcactcaagcaactaaccctgaagactgcccagtcgcaggagccaatacatctttttatgtttaaactcaatcacttcaaatgttgatcttaccttgtataatagaaattagtcgtagagactgtggtgggatgagatagcattgcgggtaatctggctcagctatggctgagtggaagaaacttgcatcaattatttatggttaatacagagtatcctagatcgtagttgtggactgaatacagacattcagctccctcccccactgagctctcataacaatgcagggactggaaagaatgtcagcatatgggatgggagaatgagaagacgggagcttcttgggcaggtattacgtagtgaggaagcagtgggtgagaacattcagtgagagaccacaatgtaaggagagagtctatctgaccagtggaagcagagactccagactcagaacctttggtacaaagagtaactacagcaaacgggcaaagaatagattgtgaatttggaggttatgtgcttccttctggcacatgaaaaaactcctaaagctttttgtgggtgcaaaatgaaataaaaatctttccccattggtatgaaaataagttaattagcctttacaatggtttgtttttgtgttactagtttccagttgtggctgtttctctcagtttctctctgttttggtttgtttgtttgtttgttgttgttttccttctcttaggaaactttggcagataattgggcacagaaattggtcattttttaaacactctaggttagtgattctcatagtccctagacatcggtatcagtattacccggcaacttgttagatatgcaaattctcaaatcttacctactgagtcatatactgccaagtgagccaaggaatccgtttaattaggctttgcaggtggttctgatgcacactcaagttgaaccactgctgaagccataactattggagacaatcttgcatagcctgaaaaatggagagctctaactgttgatagggctttgctttatttgtcttaagaaagcattaatgagaatagctttgtgtttctttgaagttctgggtgcttctgaaaactctaaaggttttcaagcatttaaatttctctagcccttttctcaaacaaacaaaaaaccccaaacaaggaaaatctcatagaaatataaaaatgagttaaaataagttgtgaggaatattctatacatcaacagtaaagtattactcaacctcaaaaattacgtctctaccataatctataatctgactggataaggactataaataaatagcatatgaaagtctacaataaagcagggagaaaatcatcactggctccgaatttcataatgacttcttgttgtatgtatgtaaatatcttctgaacaaattattgtacattttcctatctctggagaaaattaatgaattaggttaaacaatttcttaagtttaatggagcttctgttttccttggcttatgtatactagcacaggtaacttgctgaactgcagctcagaagaaaaaatctatagagaggtttagttctgaggtgaattaatggactttgttgttatgtcagaaggcgagaagcaagggaaggcaggcgggtaagagaatcgcataacgcaaaggacttcagtgcttcagaacaaaattgaagcgttttaaaaatttgactgaagtaaagttcagtaatatttttaatcatgggaaatccttggataaatgtatatggtttgataattttggtttaaattaattatgttttttctctgattttatcacaatcttagaattaatgttagcatatttttctggtttataaaatattttaacttaccagagctttctagatgtcccctactggatttatggctcagctgaattgaattattaaactagtattttttaaaacatttgttcctgtaacttgagatggggctacaaataattatactgtataggtaaaaccacacataccctacatggtaaaaaattcaaatttcatatgtaacacaattttcatgtaaatttttatattttagtataaattctctgcagtgtgtcagtttaaaatgaattttaacatactagttagctttatgagcttggctaatatttcattgagataattagtgaaaaatctttggatgagtctcataaaatttttaacatatccttgctgcatatttttacacattatagagtggctatcaagtaggagaatgaacagtatgtaaaagtacccttagttctgattaatgcacatgttcttttatactactttaagaaattaagtcagtttgagtatttagaaaagtgcatgcaatataattaatgtgtttttgcttatcaaggcaaagagagtaattttgtctaaaaggcaaattgtagagttttgctagaatataaaactgaattttaaaatacaaatttaagggcatacaataattgtagaatatctgagggaagtaaacttcatttgctatagcttataatagctgcaaataatgagtttaaatgagcaataaaacgtttataatttttggactaactttactcaatgttaattagtttgggcataaaacataaaagaacttttgagtcttttagtccaatttgttaaatggatggtctcaaaaaagtcatattagtatttgggttacctttttgataaaatgataaatcaatctccatatattagccttttttttttttttgagacaaagtcttgctcttgtccctcaggctggagggcaatggcgccatcttggctcactgcagcctctgcctcctgggttccagtgattctcctgcctcagcctcctgagtagctgggattacaggcgcctgccaccatgcctggctattttttgtatttttagtagaaatgggatttcaccatgttggccaggctggtctcgaacccctgacctcaggtgatccaccctcctcggcctcccgaagtgttgggattacaggcgtgagccaccactcccggccatatattagttttttagcaaaaatttaacacttgtattctccacagtgtcctaccggattagatatagctctcctggactaaattgtttctcacccacaacaatattgccatccgggagaaaagagatttatagtagtttactttgtactcctagaaatcctttcaagaagtataaaagtgaatacatacatatttaaatgataaacatttatcttcgtgataaaatagttaagtttccatgtgagtcaggtttaccacatgagtgatgaaccagctttaattaacaatataaccattctcctctgtcactgtaggctgttctaaaaaaagaaaaaagtttacaaaagccttaattaccttatgctatttggggagaattaagcaatgaatggagtgttgcatttaacaggttatagaaaatttttctgtgtccagcatataatcaactactaattttcagactggtttggcacaatatagattttctgccattgaatagaaactaaaaaatttgaaagtcagaaaattatttcccaggttctgaaagatatcaacaaagatatttttaattgactatgtatgattattgatttgagatttaatataccatgtctatgagaattctttgtaatacttctgcagtgtaatttgctacataatgaaaattcatttttcataataaatagtttccagaagtcatgttgtctttcttgctcccagcaagtagctctatttcttggccacattgaggaatcaaaatctaatgtaattcttctaaatagaatagagaacacctagagtcgctgctcctatgacaaatctttggataacaactctcatgtgcgtaagacattttctgatctcttctgtacttcaacttgtaaagaactttggacattacagtcagaaagtctgctattcctacaaagacaaaaggggaagcctctaaattccctgagttgtggggataattagctttcatactcatctgctgacccctgattatcagaagacatttttatctctttggcatgccccatcacctgctgtctgtctccaaaagacctgtagatcagagcaggcattgtaaggcagggacagttcctgaaatttccaattaactgatgatgggaaagctcagaaacacaaactctggggagtggctgcctggtactgctaatactcctgctggaaacaggggcacctgggctacaaacaaacgtaagactttggaagaaggtgcattaacttaattctgcctttcacatgtgagctcccaatttcccttgtggctatgagccacaagggcccaaattcaatgggagggtggttcgggtctaccatgacaagccaggatggaggagacagaggtcagttattgggagcccagattcttgccctttagaaacatgtgctgtagcagagaggaacccactacagctgggattctggactgacacagggagtgggtagtccatccagggtcacctgattgatagcaggcccttcacatctgcagcccccacctgtgacactgtttttgataccatattccccaaatttaaccctcaaatccaaaatagtaaaactactgagatgttacttatgaatacagtatctctgggtttctcagatggctgctgggaaactccagagatcctcctcctagctcttaacatgaagatatattagaaataaaggtaatgttttgcattctccagatatttaatttgctcaaaactatgctcaatatagtggaagctgctgtgtttttcaaggccatattctgagaaaatagcaataaaatcatcttaaattaattaaatgcaataattatgtatgattactgtggctatgttacaataattgtgcacttctcaggttggattcaggcatatttatgttcatgtacaaagactggtgcaataaatgtcaaccaactgattaaaaaaagtaaacttatcagttggtgacaaataataatatctactttgtggggaaaattaaaggccctggagaggtatcgggatgcactaattgttcttcatgtgttctgtcttttacggtaatcactgattaaaatttcattagatgagtatgtattacacctcaacagagaatgccactgtcccccattgtgatgttgtttgctatggcaaaaaattaaccaaactttacagttttattattagcaacatctcctccccctatccccgctgcttttttttttttttagatggaatctcgctctgttgcccaggctggagtgcagtggtatgacctcagctcactgcaaactctacctctcgggttcaagctgtcctcctacctcagcctcccgagtagctatattcaggtgcccgccaccatgcatggctaatttttctattttcagtagacacagggtttcaccatgttggccaggctggtctcaaactccggacctcaagtgatctgcctgcctcagcctcctaaagtgttgggattacagacatgagccactgtgcccagccctcctttccctttaagcatacctaaaagcctctctacaaagcgccaatcagaatttgagtcatctggaagaaatatcaaaagagctccagtaataatggtagcagacactgttgatactattgataccacaggaaattgactcatggatataggcctccaagaataggctgaccttgtccccacagacaatattccaactatacgaaataaatgagtcaggagttccaagacactcacagtgtagaagccgatgaattcatgaaagtagactgcttaactcaagaccagcacgacaagaggttgttatttaggattaaagggcctcagtaaggcaatttaattgaggctagtttaattttctactttaatgaacatgagagaaacccattttctttcttcttaatctacctttaatctccaattaaatgtacaaattattaaatttgtaaaaactaaataaaacactctgaattcttagtgttgaggaaaaaaataccttgcagaaattcttaatataaaaacaaagctaataagttgccaagaaaaacatacaaataattattttgtaaagaattgtgacatacaatatttggttttgtctattaacatacccttaattagcaatattgcttaaatcttgcacaaagtttctttaataaaaacatttactttatgtgactatgtagttatttgtattggttcaataagaatttgtcctcccttctacctgaatatattactaattagaaattttttttttttttttgagatggagtcttgctctgttgcccaggctggagtgcaatggcgtgatctcaactcactgcaacctctcaatcttgggctcaagcacttctcccacctcagcctcccaggtagctgggattacaggcacccaccatcatgctaggctactatttgtatttttatagagacggggtttcaccatgttggcctggctggtcttaaactcctgacctcaggtgatctgccggcctcagcctttcaaaatgctgggattacaggcatcagccaccttgcccagccaggaagaatcaattttttaataaaaaatttatagctgtgctacaaattcaatttaattagacaagacaaatccagtaataagaataatttctatgtttttcacgcagaagcgatgcctataacatccttctaggaaaccaatctggtgcttgctctatggactatgcaatctcaggcttggaggtaagaaagaatgtcctttcttggcagagcagggacaccgagacattggatatcttttattaaaaaggatacatttgcattataaatactgcagatgaaatcaggtagaggtgaacggactggtgtggtctgctctaaactgagctgttaaacatgtaaaagtaaatttaaagcacaagggctttataaatctatagatagacgtaaacttgtgagccttagtttattgtttcatcaaaaaaatactaggaggtcattaaatattaatcaacacttcttagatctgtgcaaataaaatggatcaaattaaaatgtaaaatcaatagtactgattaggaacattgttcagcaaatggaggtagacaaacatgtcctgtagagaaggaaacatgaccgcaagatgaagtgtaaaaaccaaagtgacattggggcctgacaccattgtcagcccgttcatcatgtcccactgctgaagaaacagagaaaaaaaaactctgcactctgacataaagaaacaataaaagggtctctctgtctacctgcagtcctccaaatgaataaaaccttgagcatttcctgagagttgctaactccttaatgaaaatcactttatccttgactttacaatgctgtttattgtctgaagatatgtcatgaactttctgaatacaataaccatgataaaattgctgttttctgccatgaagagattaatataaaccctatagtcttcataatattgtttgttttaaaaagttctatttttttaattttttgggcagttcttttgaagaatgacttcctcacatttctttgcaagtaaatgtctccttctgcttatttttccaacatgcttttgtttctgagcctttctttcatgctctatacacacaaatcagcaggagatagtacctgcagctgtatttggagtttactgcctcaatgttcactttcaatgaaagagcgtatttcttaacagaagaccagaaattcatgctgaaccaataaattgtcctctatagttttcatctgcaaggaggatttaaatatttctagctcagtagttcagccctgaagattatttcacccccactgctaatcccgacctaatctgtttttgtgttgttaatgctcctatatactagccaggtccgtaattctgtaacaggcttaatttcttaatattttaggccatgtgttaattttactatttcttagccatttttcctcaatagttttaaattgcatccctgcttactctcccttttactggatgggcttcctctgtttactaatacaattccccaaattgattcatccacttgttgaaatacctaattttaggccctgcactgacagcttgcctaggcttatacttgttgtgtttggtgttgcagtcttcagattctaaaaacaccatctagaccttacattacctccagccagggctattcccccagggcctgccttaagaagcagatttcttttcatgtttcatcttcttcccatttatttcatttcatgacagttagagaagctgtatactaacgtgacaaatgctaagttagcaaagaaaaacgttatttcaggataagttcagggaaagctttttggaggaaagtcagctcacattagtcctgatgatggatagtgtatagagactacagatgatggaacgatgaagtggaaactcgagtggctacatacggacattccacatagaagcagtgtgagcaaaaccaccaagaaaggaaatgagatggaattgataaggcaatgcaaataattcaggttatttagatcatcagtgttgggggaagctgggtttatgggaatcaatcgttaatcagaatgtgagcaccattggtttggtaattcatggaagaggttatcattcaacagggggagtggcttctcgattataaacatgtctgaaggtcactgaacatcaaggctatccttcagttaaaatcttattaaaattatactgacctctgatgaccttcagagagctccagctagatggattgatgataagagaaattcgagaaggcaatggggcaaatctttgtgcaaatctctgttatgtcatatatctaaggcttctgctggatccagtgatttgtttgttctgactgtagtacaaatctattggaacaataaatctagttataataaatgacagagggcattgaagcagatgcaagaagcaaaatatacaggtgtaaagacaaactatattaggcctcccatcaagcttctctaatattttcacagcacagccctgcctgacttctctctatctgggtaggccccttctgtttgctaaaccagttctctgatgttgactacctgattctctagtcctcaagttgactcatcctgtttattgagagtgacatttttagactactaataatatttatatgtaagaaagaaactgggtttttatataaatatataatcttttcaaataaaagattataatcaaggaactgtaaataatagaaaaattacataacgtttccctatttggggattggttaaatgcaatattatagaagtctgaaaaaataatgactgtattacaaaagaatataaaaataattgaagactaggaattatgtctaccaactaattcagtcatttggctgtttattctcatttgaacagtagtggattaagaaaaaaacaaaaagactttcgacttccatcacagggagaaaaggatcaagtacacattagagaaagctgatggcaatgatttctagtttcagtttctattttctgtcaattaaccatcattttggtaaacagcctttttaaatatcttttcttttaatttttaaatttttactttaaagacagggtctcactatgttgcgaaggcattggcctcaaactcatggactcaagtgatcttcctgccatagcctccctaggtgcacatcaccatacccagctattaatgtctttataaaagcatttttaaccctactggtctagctattgcatcaaataaatagctaattccattgacgaaggattagggactcacgagtgaaaataaatgttttatttggataatggctacaaaatctcaacagtcaaaataaataagagattaaagccatgatgatgacttaaaagataaagttaggtagaaatgtgaactaagggaaatgactcaacacattcagcaacacaaaactgtggcctaaattcactctgacagttgttatgctatctcctgctgcccgagtaaagtaagttatgaacaagacacatgaaggggatcaggcagacatatggtcaaatgctttctgtgcaatatgtctgtctccatattatcttctctgtctcattgcactttggacatttttattcttcctgcagatctatttttatgaagcaatgtgatttaaatgaaaagagcactgaattctcagccagatatttgagttctagttgaagatttatcacctagtggttatgagatttggggcaaattgcttaatctctctctttctttaccacttcgtttgtaagttttcttgcctcccttcaggactgtattggggatcaatcaatgttgagttgaaggcaacatggtttaagttggcttaatggagaagtggtaaatcacttaaacgggtagtgtttaagtgaacaacacagtgtagaggatgttgggctgcatgaggaagtgtggaaaaaaagcatgccatgaaaatatcatcacaatctcacatttcttcgtttatttgcacactctgaacacctgcatgtgataaagactgtgcaaggttctcaggatacccaggtaaaaatcaccacttctgccagtcttgactttgcaagcttgaggagcagacctggaggaatttggctattaccacaccaaagttgttcctcacattccctttgacatatggtctcaggaaaaaatgaaaagagtaaaaaaaaaaaaaaagtccttcatttttgaaaggaaaagtcataattaatttctagaaggagaaagaaaaaaagagataacagtgtgtgaaaggcttagaaaatgctagagcactacagaaagataacgtgagattatgtctaagagtagcttggttattttgcttttgttgacaaagtatacctccttcattttcatagttgtcataattctttccatgattttcttagtgggtttgtttaggagaaactgtattctttctttattcatctaactctccttaactccaaaagatgcttcttaggataacattttaaaaggatatacattacgcacatttttaatgcttctatacaggactgaaggccaatattaccatgataataaggcatgtaacaaaaatttgttctgcagagagtgagaaagcgtgagggaaaacacagtgcaggattctatgctgtcgcccaagaacccagacaggcaagtgaaataatagagcagacatttcctgaggctgtggtcgatatgattaggagatagtgggtaaaaatggcctttaaactatatacacatgagaagatagatgtgaaagcccattgcaaaggcaataaaattatgcaaatataaaatatcactattaaaatgtatgatgaattgacgtgccatgaaaacagttccagtgctgggccagaaatcaggaaacgtgggcttttggtttctcaccattaaaatgaagaagttggatttatacccaagggcaccttgtgggctgtatggcttctaagtaactggtcataacaaaagggacacaatcaggtcagtttcaaaccaagaataaaatgggaaattaaagaactgaattggctactttctgctcaaatgattgttaaaaataaagtttaaaaaaagccccaaggactatgcagtgcagtgagcagaggctcccgatattaaaaagaaaacaaggaaaatggattcctggtgatagaagtggtgtgggggaagacaaatagtgtggctgcaaatggaacaatatgcaaaagaaaagtagctaaatatagctcttttttgggaaagagattgtgtctaagtccatcagtggaaaggcaacttaattgttgtataagtctgttcaggttgccataacaagataccatacaccaagtggcttaaactatagaaatgtatttctcacacttctggaagttgggaagtccaagataaaggtggtagcaaagcggattcctttctaaggtctcttcctatggcctgtaagtggctgtagattcactgtgtgcccatgtgaccatttcttcgtgcaccagggggaaggcggacaagcaagctttctagtgtctctcttcttgtaatggcattaatctcagcatgaggacaccactctcataacctcttttaatcctgattacctttcaaaggccccagctgcataaatcatcacagtgggtgttagggcttcaacgtttaagtgcgggagttggtgttcacatttcagtcaattgaggtggcaattgaaatgagaaaggaaaaccatagttactagagagaacggttgtcttggggaggatcactggacaggactacggtcctgtccaggttgttatggcaacctgaacagacttatacaacaatccagtcctagaggcaatacaacttctctgctgattccagattctgagcgcctctcagtccttggttgggttgttttgatcctgtccatattatatttataaatattctcttcataaaactctctttaggccgggcgcggtggctcacgcctgtaatcccagcactttgggaggtcaagagatcgagaccatcctggccaacgtggtgaaacccgctctctactaaaaatacaaaaaattagccgggtgtggtagcgggcgcctgtagtcccagctactcgggaggctgaggcaggagaatggcgtgaacccgggaggcggagcttgcagtgagccgagatggcaccactgcactccagcctgggcaatagagcgagactccatctcaaaaaaaaaaaaaaaaaaaaacacaactctctttaaatcacacatccgagtgtgccccttgtttcccaccagagccaagactgaatgagatgatttcttaaggtcaggttgatgtcctaatccagttgtgctgctataacaaaataccacagagtgagtaacttataaacaacaaaaatttattgctcaagttatggaggatggtcagtccaagatcaagttgccagcaggttcagtgtctagtgaaggcccattcctctgtcatccaggctgaagtgcagtgttgcaagcttgggtcactgcaaccttcacctcccaggctcaagtaaccctcccacctcagcctcctgagtagctgggaccacaggtgctcaccaccatgcctggctaatttttttttttttttttttttttgtagagatggggtttcaccatgtttcccaggctggtctcaaactcctggactcaggcaatctgccagcctcctgagggagtgctgggattacaggcatgagccactgtgcccacccccaaaattctactcatatatatgcataattacatagttaccagccgttattttctgatactttgactggcaattggttgaaagagtttatctaaagacctggaatccatagaaggcagtctctgtgttaaggggttgttcttattatgcagatgaagcctccaggtagcaggcttcagagagaattgattgtaaatgtttcttatcagacttaaaaaggtgcctagattagggaaaaggcctggaaagggattccctgtagcatgtagactttccccacaagagacaactttgtagggacatttcaaaatatgataaaaaatgtattttagggtaaaatatttgtatttctttcagggcctgctatctgtcatgtaatgctacactagagtcagcctggagtttggtgtcttattgctacaaaaagtcttgagatcgctgttgtaatgtcagttgggcctggtcggatgtgctggtcagttgtgcctgaattccaaaggaaggagggtataatgaggcatatctgacccctacttcccatcatggtctgaaccagtttttcaggttaactttggaatgaccctggctgagaggaggggtgcattcaaatagttgaggggcttggaattttatttgtggtttacactatagaaagtatttttccagtattacctggacaatgtgtctccctgtcagtatccaggaatggcacctggatcaagcatttagtgttcagttgctacactctcacctaatccctcattttcaatattttgccatgttttccagtgacccaactggccaccatgtcacagactttatggtctccaagggagacccctccatttcatgttttgtgatttgagcaacagactggaatctacttgaaatttgcaaatggtctttgacttgggctttccaattttgctctacttcacagtgttttctgggttatatacaagggagatgatccagtcatttgttaagcgcctcaaataagacatgccctagatgtttttttgtttgttttgtcaaattgggattatctttgtgtctttggagaatataaaatactaacatgaggtaagcactaaggttctgagatggccgtggaagagatgacaaactccatcaccatgcctgagagtgtccaatcgtctctgcgggggccacatatttttgtattacactgtatttgaaataacaacaacaacaacaaaaaacccttcaagattcataaaattggacaactgtctttgtaacacttctagtggtaaaaccagtaaggatggctagtttgcaacccatctgagcagcctctctggtttcatagatatgttttctctctgacattgaacggctttcaacttgaaacggaatgctacatcacaaagataaacaggtttgaaaggaaccggttttccttgtaatcctaaacgttcaagtctgcgcattaaaagacattatctgaagaagggtgcacaagcttcctgttggccgccagaagggttctctgcaggacacagatcaagtaccacagtcttagggggagaccagacgcgggatctctgcacacctccccaaaggacaatggcaggaggaaaaggagaaagagacagacgtcacttcctccgccagctccggcagcgggttgatcggctgagtcggcggagggtggggcggaagagcagacggggactgggaaaggcgctgtcggtgacatcacggatagggcgatttctatgtagatgaggcagcgcaggggctgctgcttcgccactaaggagttcccgtgccgtgggagcgggttcaggaccgctggtcggacctgagagtcccagctgtgtgtcagggctaggagggctgtgggcggtgggggggtggggtggggggggggggcgttcgcggggcaagtgaccgtgcgtgtaaagggtgaagcgtgtgaggctgtggcggggcggaggtgcaaaagctcatacttacctggaaggggagataccatgatcacgaaggtggtttttctcagggcgaagcttatccattgcgttccggatgtgctgacccctgcgatttccccaagtgtgggaaactcgagtgcataatttgtgatagtagggaactacgttcgcgctttctcttggtgtttctgtggtgcgaatagtaggtgagccgtaagtgtttttgtaattcagggtgcgggctcgtgttttgtggctgtgttctgtccggtcagttgtttccgttcgcaacggttagttttcctttgtgaggccatgtttggggacagcttagaactatccacttgctctcttgggaggcgaatttcagtctctgttggttgggttgttctcccaggttagctgccgcggtacttgctaggtggagctcagggatcaagggtcgggagctttctggtttgttcagtgctcccagggcttctaacatctcttaaaaactctggtgttttctgtcatcctcggagttacctcttagcctctgtttttttgttgttgttttttccccccctccctaagacaagtctcgctgtaccgtccaggctggagaagtggcgcgatcttcccatctcaggctcccgagtaggacaaccgcacgccaccacacccggctagttttttctctttttttttttttcttttcttttctttctctttctttttcttttttcgtagcggtttcaccattctgctcaggctgggctccaactcctgggctcaagtggtccgcccagccttctgaagtgctgggattacaggtgcgatccatcttgccctggcagctcctgcttttcaccacagcattcacgggagtttgtaggatttctgtgctggggaaacgtgtactcagttaatagagccaggtggaagttgtactcagaactggtggttttctttggaatgaaaaccgtgcatgttgggggctcttagtgtccccgttcggttgtaggcataacacccttgctttgtgtagggggagggctttgcccatgccctggtgccccggcgcagggcatcgaggtctgcagttcagaaccgcagtctaacctatgtcttggcggaataccctgctaagtctccctggaatgtaagatgggaggtcttgtgaggaggtttctacaagtaagaaaacaaatttccattcggtttttattgacaaaattgaaaattataataactgagtccagcctctcagatgacaaatgtcttttgcactgagagctgggaaccgccgcttgcctcagctcctgcgtgcaggtgcagccctcgcttccctccacactttctccagcgggtgtcagttcctccaccagaggcagacagcgttctgcagaaccacagcgctcaaggccttcgagagccaaaaatctcggagcgagctgccctgtcctggctgtacctcacgactgacctagaaatggcctttgctgggagcaaagggtaggggggagatggtcgtcggagctggggcctgtgcactggaccaggttgacccacgggaggggaggtacccagagttagaagggggccaagcactgagacctcaccatcctcaatctccaaaaggactcagagagatgcagagactgagacaagcttcctttttcaaggaaagagaaaactactgaggaaggccccaggggctctgaaccaaaatccagacttttttttccacctgcagctttttgtttttatttttgcttgagaaggtgtctcggtctgttgcctgggctggagggcagtggcgcaatttcggctcattaaaacctccatctcccgggttcaagcaattctcctgcctcggcctccctagtagctgggactacaggtgcccgccatgacgcccggctaatttttgtatttttattagagacgaggtttcaccatgttggtcaggctggtctcaaactcctgatctcaagtgatccacccacctcagcctcccagagtgctgggattacaggtgtgagctaccgcgcccagcccgcacctgcagcttaatcccatttcgctggtgcaacttcatccttccgtatgctcaggccaataaacagtactgtaggctggtcgttctttgacccccatacatcctattggtcggaaaattatgttttctctttggttaaccgcagactttgatatgcacactctttcttggtctgaaacccacccaatagtcccatacgtagatttttggataaacatagaaatggacccttctgatctgaaagtttgaaactcgatatttgttttatttgagttccttccttcaggcctctcaaaaaagatatcaaagaactgaaagtcacccagacaatgagatgccggacccctcattcatcctgattgcttccttgcccctccctagttcctgttttctttcttttcttttttctttttttttcttttttctttttgagacagagtctccctctgcctcccaggctggagtgcagtggcgctatcttggctcactgcaagctccgcctcccgggttcacgccattctcctgcctcagcctcccgagtagctgggactacaggcgcccgccaccactcccggctaatttcttttcgtatttctagtagagacggggtttcaccgtgttagccaggatggtctcgatctcctgacctcgtgattcgcccgcctcggcctcccaaagtgctgggattacaggcgtgagccaccgcgcctggtctagttcctgttttcttacacattgtcacattctttccctgccatctaagcctctagttttggttggtcagggagatggatttgagactgagttctcatctcctccgctgcagcaccctattaaagcctcttccttggcaataaccgtctcagtgattggttttctgtgtggcaagcagcgggaaccccaggtctctgaactttgacaaaggaatctcctgataaaggcgggatcgattttactgaccaagctgaaaacgatcagacgtttgaaagccttaatctcggagcctgtcggagtttggtctgcccttgaggcttttctttgggcctaccagtcaaaatcagcctggccaaacctgtcttcaaggaccaggggcagggccggcttctcccgccgggtcggcagccaccttccccttccctgtgacttgaagagaagcttcagggggcgtttattcaatttgcgaggagcctgcgaggcgcaggtgcgcggtgactctgtggttcccaccgcacccgctgccctctttggtcctctcgctgtcaccggcgggcagtaacgttccgggtgagctagggctccgaagacaccaggcagggagggaccagtgggtaagggcaccgcccgtttaggtcctgcgcaggagggatccgaaaaaggtcttgaagaaatagaaagggagggccagatgcggtggctcacgcctgtaatcccagcactttgggaggccgaggtgggtggatcacgaggtcacgagttcgagaccagcctggccaagatggtgaaaccctgtctctactaaaaatacaacaagtagccgggcacggtgacgggcgcctgtaatcccagctactcaggaggctgaggcaggagaatctctagaacccaggaggcggaggtgcagtgagctgagactgccccgctgcactctagcctgggcaacacagcaagactctgtctcaaataaataaataaataaataaataaatagaaagggagagttggaagtagatcaaagagaagaaaagaaatcctagatttcctatctgaaggcaccatgaagatgaaggccacctcttctgggccaggtcctcccgttgcaggtgaaccgagttctggcctccattggagaccaaaggagatgactttggcctggctcctagtgaggaagccatgcctagtcctgttctgtttgggcttgatcctgtagcacttgattgtctctcctggactttccatggattccagggatgcaactgagaagtttatttttaatgcacttacttgaagtaagagttattttaaaacattttagcaaaggaaatgaattctgacaggttttgcactgaagacattcacatgtgaggaaaacaggaaaaccactatgctagaaaaagcaaatgctgttgagattgtctcacaaacacaaattgcgtgccagcaggtaggtttgagcctcaggttgggcacattttactttaagcgcactgttggtggaacttaaggtgactgtaggacttatatatacatacatacatataatatatatacatatttatgtgtatacacacacacacacacacacacagggtcttgctatcttgcccagggtggtctccaactctgggtctcaagcgatcctctgcctccccttcccaaagtgctgggattacaggtgtgagccacctcgcccaggccattttaattttaatttaatacttttaatttgaatacacaatccaaaaatcatataacaagtacaggaaacccactttatgccaagtttacaaaaacaggaaagatatgtcaatgacaaagcgtcaaagtggcaacatcctaaagtactgagagaaaaaaagttattctagaattctatgccaaattgaaatatctttcaaaaatgtgactgaaatcaggacatttaaagacatacaaaaaaatgacagaattcaccgaaccacactacaagaaatattaaaggagtcctccaggcctaaggataaggataccaaacagaaatctgaacctacacaaagaaatggagacgactgaaaatcgctatgtacgtacttggatgttggggtttataacatgtccaaaatcaaattccctgacaacactagcataaaggccagaaggggaggtataatgtcacttgatggcagacggataaagatgtattctagggaccctaaagccatcactgacataacaaaagaaagagttacagctaataagccaaataaggaaagaaaatagaatgatatataaaaaaaaaacatgtaatcgctgggtgcggtggctcatgcctgtaatcccagcactttgagaggccaaggcaggcagatcacttgaggtcaggagtttgagacctgcctggccaaaatggtgaaaccccgtctctactaaaaatacaaaaattagcccgatgtggtggctcgcgcggacctgtaatctcagctacttgggaggctgaagcaggagattcgcttgaacccgggaggcggaggttgcagtgagagctgagatggcgccactgcactccagcctgggtgacagagcgagactctgtctcaaaaataaataaataaataaataaataaacaaacaaacaaaaactgtgtaatccctatgctggagcaactgctctccaggcctctaccctatagaaatacacaaatggccaatgagaagtgtacaagaatgatcactgccgaattatttgcaatcataaaatagtagcgccaaagtaatttcaaagatacatgaaaatcgttttatttatttaacaaacacaaacaattgaacaaacaatggaagcaagtccttttgcctaaagaaacacagagggtcatgcggatgttgctcctccaaggatttcggtgttccccaacggctagttttgggtctagttcttctggaagatcttattcttggggagctacaggttctggcgtttggggctctttcaggttctatctccattttcccctcaattcctccccattctgctataataaaaaaaaattctcacctccggaagatcccgcctgtgcctccccgccagcctttcaggaggtctggacgtctggtccaccgctccccggcttctttccccgcttttgcttttcccctcccctgctcccgccctccggcctcaggacccgaccaccgcccagctgagcccccgcggctccacggcgcagaaggtgcactggaggccctgcccgttgccgccccgcggggtgtcaagaagtcaacgtaaataaatgctttgtaaaaggaacttccccatggaaaaatctctcatgatttccattctcaaggctcttcaaaggactaaaagctaaaaggatggattcattcgacaagtcctagtcctgcgccctggtgagtgccagaccctgctccccgtgagggggacccacgagccaccctcaccacgatccctgccctggtggagcccccgtgcggaacacaggatccgaagatggcagcggaagctccgcagcggccccaaaagcgactgggcagggagggcacaggctccctcactgggtgaaggcggcgcaaagaatgggaagagccatcccgggagccaccgggcgttcagcctccctagggcccccaggcggctcgggccggggtctcaaccggggcgtttccgggggtttctgaagcaggcgaggggcagggcgggcgaaggccattcggctatccttctggctccagaatctcccaacgcgcaggtgtccaacgtgaccagcgcgacttaccgctccaatctctccagttttccaaggccttgctcagtcctcctgccgggcgggccctgaggatgcaagggacggaggaagtttcgtgcgtgcgcccttcctatagcgcccagtagaactaacagtacctgtctctgtggcgcaatcggttagcgcgttcggctgttaaccgaaaggttggtggttcgagcccacccagggacgcctctttgagcttttaaagtattcatgcattgtcaatcactagataaatggggaagattttatcttcctggagtcctaagccactaatttgtgacttatccatgtcaagggccagcccacctccccaaccggattcttaaccgggtatctcctgaaatcctgggtttatacgtgtgtaactcaggaatcctgaaacagagacctaggaacccacttctggtgtgataaaattctaattcagtccgttatacgcttaaatgagtaatttacatgcctccattttttcatatgttaataataggaggtcagtaatatcccgaggatgtgcctggatttactgattgctctatcaataatgtgaccagtggaatcattcatcatcatagtgatcctctccatcatttttgaagagtatttttcctcagtttgtgcatgatttatttaacccttttcaaaatgtttttgttagccaggcatggtggcatgtgcctgtaatcccaggtacttgggattctgaggcaggagaatcatttgaacctgggaggtggaggctgcagtggaggctgcaccaatggaggctgcactgctacactcccgcctgggcaacagagcgagactccatctcaaaataaaaataaaaataaaaaaataaagtttttgagatgaggtaggtttcattgttttaggattacaaagaatgctgcagccacctttcttgtacacatatctggtcattgtggaaatgtctacaccgcagatatttctatagtgtagggaagttgatgcactattgctacattataggctttacatgatgcttctaatttgagtacattctgcaaatgtatctttcacgggagccgtaccaaataatattccaatagcaatatttataggaggaaaaatgtgcagaagtgcaattgagcttcgtgcctctccatggggtccatgttcataaaatggtggcattagcaatcatctgagagtggagtttgtggccctctgacatcaaaagctgaagcagaggacatgaaaaccctcactgtgcatcctctctagtctggccagaatcattcctaggtcggtggtctcttatcaggagggaatgctgcttgcttgttttgtcaaaatcacaaaactgagggaaagcatcaggccgttggttggtaacagtggtgaagcaagtctttccaaagggctggtttgttgttaacccttagggaaaaaaaaaagccttttttttttttttttttttttttttgagacagagtctctctctgtcgcccaggctggagtgcagtggcgtgatctcggctcactgcaagctccgcctcccgggttcaggccattctcctgcctcagcctcccgagtagctgggactacaggcgcctgccaccacgcccggctaattttttttatttttagtagagatggggttttaccgtgttagccaggatggtctcgatttcctgacctcgtgatccgcccgccttggcctcgcaaagtgctgggattacaggcataagccaccgcgcccggccaaaaaagcctaattcttaccagctggtgccgtgcagttccaggctcttggtgtcccaaacaaagacaccaagagcctggaactgcaccaaaaaccaaaaccaaggtaggggcaagatgataatcacagaatgtcaccggtatatgtttaggttcaaatactattatgagaagtggcaggtaaaggaggtaggaaaaagaaaacacatcatgtaattgactgttgtatggaaatatttgatgctgaaagttataatttaaaactataaaccaaatattagaagtgtgtctagttaaaagggaggaaaaccatcaaaaacatttttagtgcaatatttaacatgagctatacaacccttcctaaatgccaaaggcacacacagacacacacgcagacacacagacacacacacactcacactcacgaagaatacaaatgactagaaccaagaaatgtaaatacattctgctacgtatggtaaacatagcctacaatgtggaagagattagaaaataaacatggaaatgaaatgtttttattaattcgcatcagtacccaccaaaaccaatcagcataatcaaatattataacactgaatgtaaaaaacaatccagaagtccagagtgataggcaaaaggttttaattgtatagattaaaattaactttggacaaaaattaaaactcaggcagagaatgtcttcttctttttgcaacagcagacactagtaaaaacaaaggcacagtaaaaattgagacccaaaatttgcagtgtagagatatgaatataataatagacacaggcagggaggattaataaatgataaaatgtttagaggatgatcattagaatacaggatatttatactcttgaaaaccgctttcccaagtacttcttcattataagtaaggtgtctctaaaagggacagatctcctagacccctccttaaccaagtaaccagtcctgatatcataatggtgatggacaaactagaccttctctgcccgcagatgggctgaggttggaaactcacagcattgtctctgcagtgttcccggcaaaacgtttaggctgaatttaatcatgaagacattttcagacaacttcagaatgtagatcattgagccagacagctgacctgtcctctataaacaagtccatgtcaccaccatccatgacaacaacaaaaagatgaggaaatatttggggttcaaaataactaaagaaatgcagctacattatctttttacgttttttgaacccaaaatatctcttctcctttttgttgtgtgatttgtggtgatatggactatgtgaaggagacaggtcagttgtcctgctcagtgttctacattctgcagttgtctggtgattacctcctatgaaactcaggctaagcgttttctgcaagaacatggcattgttcatattctgcaccggcagagtcctgggtgacatgctgtctcctgccagcggctcctgactcctgttctctacaggatggaattgagaagagcagggctaaggcctcccaatgctgtttgtccatctagctgtggtcttcctaagtactgacaccaattggaggctgaaggactgtggcttctctaaccaaaggagcctagcgggttaacaattgtcaagagcagttggtggttctgaaatacaatcctcaaccaaggatccctcctgtgttacagatggatcagctaaaacaagccaacactgaagacacaaagaatgaggttaggttcattgaaaccagggtaacacctttggatgagctaaacacaaagatgacaatgaccttgagcaggtatagaagctcagagacatgcctgcaaaatgaaatccctgaggaattttgtagctacccagagatacgtggttcaaattaaaatgtctgactgatcactcccggcatgtgctgcacagttatgtgaacgtgtcacacctaacgtgggtccattgtcttcagactgagcacaggttgccactggcatggtttgagaataggaatacagccatgcccactgacccatcctatgtctgggcttccaaatggaactgtactttcattcaaatcttcacgtgcctataggtcctgcctgcaggaatgacatctctcggcttagtaagggctgtttattgtgggaatatgactcccatctggaacaccaggtggagacttgtcaccgtcaaagtaaaaaacctattgtccacgtaaagggcgaagctgatgtgctgttcctcaaatgagtaaaacacacttctgtagtgctggaatgagtcaggtagttcaaagtacattgacggagtagaataacatccatccagtgagtcctgtaagacttcaggctcttccacttccatcagcacgccgttgagcctggaaaaggagacaaaactaaagaagcagccagggaaaatcagaaaccacagagccccactagatttcagaagtcacataaggaagtggttagaaaagaaaaaggatagatccattaatgaggtaaaaaaaaaatttattgcctatatgttgggatagaacagggccaggtagaaaacaatgaaagagaaagacagagagagagagacagagacagagagagagagaaagtgacctagtgaattgcccaggtgacatactggtaagggagtcaaaggacactctgagttagtgtcctcatgacacacagcaaactgtgatcatgaaaagagtgagctcaatagttttccataaaatatgctcaaaattcgatgcagtggccatgagagtacagcttttgaagtatggtcaacctatggcacgttagtaaaagataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttcttttcttctttgatcttcttccccttcttttcttccccttccccttcttttcaatttctgcaataaattcagacatggacagacacattaagctgattcccctacacacataacaatccactgtctaatcctcacacagggacctcaggctccccagcataagaataggacactttgagagatatatttcaggaggcctgaaggctgttcatgatagaacttcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacagacacacacacacacacacacacacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagattgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttgagtccaaatcatagttctgtgaattctttacatctgcctgggtccaatgtgctgagagcgggctcagcttgccacaggcatggctggagactaggaatagagccttgctcactgacccatttcatgtctaggcttccaactgagactacagtttcattacaacttatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacagagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacagacacacacacacacacacacacacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagattgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattctttacatctgcctgggtccaatgtgctgagagcgggctcagcttgccacaggcatggctggagactaggaatagagccttgctcactgacccatttcatgtctaggcttccaactgagactacagtttcattacaacttatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatatcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtggggtttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacacagacacacacacacacacagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaagtctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacacagacacacacacagacacacacacacacacagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagaggtagtcttcaggaggcctgaaggctgatcacgatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacagagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgtcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagaggtagtcttcaggaggcctgaaggctgatcacgatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacaaacacagacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatttaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttggcatagaccagggccaggtagaaaagaatgaaagagaaagacagggagagggagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttggcatagaccagggccaggtagaaaagaatgaaagagaaagacagggagagggagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaacaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagttcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaacaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagttcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaacaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagttcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacacagacacacacacacacacagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaattctcacacggggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagcgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccatgggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacgcagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtacggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacagacacacacacacagacacacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacagacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagactttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacgcagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtacggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacagacacacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcgacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagcgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaattatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacggtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgtcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcatggtagcgaggattttagacgctgaaattagagtgaaggatgaaatctacaagatctacaaagttgagtcaaaatcagagttgtgtgaatttgtcacatctgcccaggtcgaacgtcatgagagtaggattagggcaccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaatacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaagaaattattgcctttatgttgggatagactagggccaggtagaaaaggatgaaagagagagacacacactcacacacacacacaaacacacacacacacacacacacacacacacacagagcgagctcagtgaattggtcaggtgacacactgatgagggagtcaaaggacactctgtatttgtgctctcaggacacactgtgaacagtgatcatgaaaagcatgtcctcaataattttgcataaaatgtgctcaagtttccctgcagttaccatgagaatacagcttttgagttatggtcaactttcactaggttagtaaatgataagggtaggaagaaatggaaacctaaacatgtactctaatgagaaccagaaagcaatgtagtaggcataattcagacttgtctgacaagacaaaatcattattttcagcatgtactgttttccctggacttggcatctccaggtgtcaacatcaaattaactctccacaatttctcagactcacctgggacctgttgcctcttggtcctcctttttcacttgatcccaccgatgtcctgcaaataaattcagatgggccctcttacattaagcagttcttccttgcacacagaaacattcctctgtccaatcctaacacagggacatcagtcttgtcagtgtgagaacaggagactttgagagaaatattccagtaggcctgaggtcaagtcttgagaaaactggcttgggttctttcatgagccttgggcaaaattcccctgtgttggaatgttatcttccctatgtgctctgtcctaggcttctgtacacaaatgagaaattttttccccaataaattgtaggcaaatagttctaacacctcataggagagacacttcaatattaagctttctctcatcaaatacccagaatttgatagtttatgagattgtggacacagagatttgatgaaggggtgcaatgtaccagctcttgagtcaaaatgaaacttggttctacacagaagcatcagctattatggcttttgtgggtgaaaagtcagccatttatctagaaaacataccaggaacatgatggacagatgagctaaaacaagcgaacttagaagacacagaaaatgggaataaattcagtgaaacctgggtcacatctttcactgagaggtagacaagggtgacactggccttgggcgggtaaagaaccacacagacatgctttgggaacaaaactcataaggaattttgtagctggcaagagacatttaattcagatgagctgagctgacagacaactcctgggcatgtgctgcatagtttggtgtgagtttgccacacctgccttgagttcaatgtcgtgacaatcagtccaggttggcacgggcatggcctgagactaggaagagagcaaagctcactgacccaccccatgcctgtgcttcagactcgactccagagtgattgaaatctacattgatatataggttcagcccacggtgatggcaaatctcagcccaacaaggggcacaaggcccaaagattatggggtctacctgggccatgaactggagctttatcaccttcacagtgtagtactcactgcctatgtcaacagccatgcagacttgctgttcctctaatgagtgaaatgtgctgctgtaagactggtacgaggccaacatttcaggaggaattgagagagtcgaataaccttcatcccaggactcctgggggacttcctcctcttcagactcctgcagattcctgatgagccaggcaggacagggatgatagaagatttaaccaacagacattagacaacaaaacctcccagatgatctgatgggagacagaatggagtggtcacagaaaccaaaggcatttttccttcaagagaaataaaactatccttctaaatgcagggtggagggtgactgctctggggacagagcaaaaatgggcagcatgtgctcagtacatttgccacagatgagccaactcagggcacccagactctccctgtaaactaccatcatgacttgcagcacagagaactgacacagggcttcaactactttgcataaattgggttgaattttacatgcagcattcaagtgaagagagttcttgacgcagtgcagacacagatcttgtgtattaagggccccattttcccaatattttgatataatatatttactttttcaatttcttttcttgcaaaaatactagccaacatactaccaacaaataggaaaaaagcatgtatacacctctccctggatttaaacacatcggagagaataggcaacaccaagaaatccctgtttgagggtctggagtggacttccagcaaactccaacagacctgaagctgagggacctgactgttagaaggaaaactaacacacagaaaggaataacatcaacatcaacaaaaaagacatccaccccaaaaccccatctgtaggtcaccatcatcaaagaccaagggtagataaaaccacaaaggtggggagaaaccagagcacaaaagctgaaaattccaaaaacctgacatcccttctcctccaaaggatcgcagctcctcgccagcaatggaacaaagcaggatggagaatgactttgatgagctgacagaagtaggcttcagaaagtcggtaataacaaacttctctgagctaaagtaggatgtgcgaactcatcgcaaggaagctaaaaaccttgaaaaaagattagacgaatggctaaccagaatgaacagtgtagagaagaccttaaatgacctgatggagctgaaaaccatggcacgagaactacgtgatgcatgcacaagcttcagtagccaattcgatcaagtgcaagaaatggtatcagtgattcaagatcaaattagtgaaatgaagcgagaagagaagtttagagaaaaaagagtaaaaagaaatgaacaagcctccaataaatatgggactatgtggaaagaccaaatctacatttgattggtgtactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaaaacacttaattgtcagattcaccaaggttgaaatgaaggaaaaaatgctaagggcagccagagagaaaggtcggattacccacaaagggaagcccatcagactagcagcagatctcttggcacaaaccctacaagccagaagagagtgggagcaatattcaacattcttttttttttccatatgtatagttttcctttattattttttgtgtgtatgtatatatatatatatatacagatatatataatactttaagtcttagggtacatgtgcacaacgtgcaggttagttacatatgtatacatgtccacattggtgtgcttcacccattaactcatcatttaacattaggtatatctcctaatgctacccctcctccctccccccaccctacaacaggccccagtgtgtgatgttcccctttctgtgtccatgtgttctcattgttcaattcccacctgtgagtaagaacatgcggtatttggttttttgtccttgcaatagtttgctgagaatgatggtttccagcttcatccatgcccctacaaaggacatgaactcatcattttttatagctgcatagtattccatggtgtatatgtgccacattttcttaatccagtctatcattgctggatatttggcttggttccaagtctttgctattgtgaatagtgccacaataaacatatgtgtgcatgtgtctttacagcagcatgatttataatcatttgggtacacacccagtaatgggatggctgggtcaaatggtatttctagttctagatccctgaggaattgtcacactgccttccacaatcgttgaactagtttacagtcccaccaacagtgtaaaagtgttcctatttctccacatcctctccagcatcttcaacattcttaaagaaaagaattttcaacccagaatttcatatccagccaaacaaagcttcataagtgaaggagaaataaatcctttacagagaagcaaatgctgagagattttgtcaccaccaggcctgccttacaagagctcctaaaggaagcagtaaacatggaaaggaacaaccggtaccagccactacaaaaacatgccaaactgtaaagaccattgacgctaggaagaaactgcatcaactaatgggcgaaataaccagctaatatcataacgacaggatcaaattcacacataacaatattaaccttaaatgtaaatgggctaaatgccccagttaaaaaacacagaatggcaaattggataaagagtcaagtcccatcagtgtgctgtactcaggaaacccatctcacatgcagagacacacataggctcaaactaaagggatggaggaagatctaccaagcaaatggaaaacaaaaaaaggcaggggttgcaatcctagtctctgataaaacagactttaaaccaaccaagatcaaaagagacaaagaaggccactacataatggtaaagggatcaattcaacaagagttaactatcctaaacatatatgcaccgtatacaggagcacccagattcataaagcaagtcctgagagacctacaaagagatttagactccacacaatcatcatgggagactttaacaccccactgtcaatattagacagatcaatgagacagaagcttaacaaggatatccaggacttgaactcagctctccaccaagcagacctaaaagacatctacagaactctccaccccaaatccacagaatatacattcttctcagcaccacatcacacttattccaaaattgaccacatagttggaggtaaagcactcgtcagcaaatgtaaaagaatggaaatcacaacaaactgtcagaccacagtgcaatcaaattagaactcaggattaagaaactcactcaaaaccgcacaactacatggaaactcaacaacctgctcctgaatgactactgggaaaataacaaaatgaaggcagaaataaagatgttctttgaaaccaatgagaacaaagacacaacatatcagaatctctgggacacatttaaagcaatgtgtagagggaaaattatagcactaaatgcccacaagagaaagcagaaaagatctaaaattgacaccctaacatcacaattaaaataactagagaagcaaagcaaacaaattcaaaagctagcagaagacaagaagtaactaagatcagagcagaactaaaggagatagagacacaaaaaacccttcaaaagatcaatgaatccagggctggttttttgaaaagatcaacaagaaaaccctgtttggctagttcacctggctcatctgatggcaagttcctatcttgagaggactatgaaattaaaaccaatacaagtgctacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggccctttttcttcctcttcctcatcatcactttcattttctgtaaataaattcagagaagcaggtcacattaagcaattcatacttcacatatgaacaaatcactgtccagtcatagcacaaggacataactattctcagtgcaagaataaggattctgacaggaatattctagggtgtcctagattaactttggtgagaattagataaccctgctttccagacccacaggccaaaatctccctctacgtgtagaccataatgccatattccctgcctgagtcaaagttaaacaaaattttttccccaaaaaaatctccaaaaattggtcaaacaattttctaagagtgctgctgcgatacggacttatatcaccaggtaacatggacattaaatgtttagaggcatctatacatgaaacacgactgatagataaatttgaacaactcttgctttaaaaagaatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagccaagatggtgccactgcactccagcctgggtgacagagcaagactccatcacaaaaaaaaaaaaaaaaaaaaaaatccacgatgctacaaagaaacattggatcagccattgcattgacagggtggagaaccagggtccagccttgctttatggaaatatatcagcaaagtaaagaagaaaagtttctgtcctgatttcagggtgactgtgcagctaagcaagctgacttaaaggagatccagatgaaagctgagagcagtgaagccgggggaacaatatttccaaatacaaaggcaaggctgccagcttccttaaacaggcatagaaattccatggacattgttcagggacagaggacttaatcacagatgacaagagatactgaatcgaagctagtaggcctgacagatactgcctgtgcacctcctgcactcaggtgactatgagattgtcacacttgcctggggttgagtaacttgatactggggactggcagacaaagtcatgacattagctgagaaggacaaaaaaagtccctgatatctgtttagaaacccatcacagttttttattcaaatgaatttgtgtttatagagcctgtcttcagagtttatcttcctcagcctagagagaggtatgagacacaaggaaaacagaggctacctggaataatgtgtacagcatcctcccattcaacatgagaggatgagccaatcagagttgagtcgactttgtcttcctcaaatgtgattttggttttcctatgtggctggttggagtcataagggccatggctatttgaataagtgatggcacattcctcctgtgagtcctcagggacttccttttcttcagccttctgcatctccctgatgagccaggtgggacagagatgacagaagattaaacacagagggattggaccccagggagtcctagctggttttgacaggcggcattaagagagtggtcccagaaagcaaaatggaggttcccattaagggggaacatgcaatcctgttctctctgcaacagagcatggctgccatgggaaccagagaggaagagagcagctgctgttcattgcactggacagataggagctgaggaggatgaagactcagctatccctgtacggtgcagacgtgacactcggcacacacagagaaacatgacagctgccgcaccctgtgtctaagctgggttatatttcacatactgtggccaagcaaatgtgggtttttggccgatcatagatgccagagagggtgtgcctcctagatattcctcatatgttaccatccattaattgttcctgagtattcagtgttacctgggggcagacgatttctgcactttctcagccaactcaacttgaacatcttcatcgtcatcgttgtcattttctgtaaatacagaagtgttcgttcagatatttcccacttcacagtctgcaagcacagtcagcccaatgtgcaacagagacatgaacatctaggcatgggtcaccgttcaactgaaaactctcatgttttatctttaacagaatgccctggcatggtttcctgatccatcaggcaatgcatttctgatctggagggccaccatcaagatgtggccaaatattgaaaagaccttttgcttcccatatcactggaggcttgtgcagcctctctctggacgttggcagctgtctcccccatcctgccagatctgattcccaggcacaggcttggtgtcctgtcacggtttgcatttcaaacctcattctttctcttagaagcagacaaacttgtcccacagtcctctatgcatcagaagatttcaagcctccaagtggcttctgctgtgttcttcagggacattctatccatggggagtgctccagtctgaagcacttcctaccacaaaacgcccccacataaagtgccttctccaacatcacacggcgagggccttcatctcattttggaaagcagttgtaagtgttcccacatttgaatgcttcagacccttgcaagagacaatttgtctgccacggagagagagaaactcaggaaggacaagtcattcactctctgacagttactaagaacattgccgaaaagacagcctgggaaccttcattcttagtgcagagctctttcactctaacaagcctgctcccatcgcagcctccttcctgtcctttaaaactagacagatgctgcctcttgctccaaagaccaccttccatcaagggaggagggacacttgcaatactgtgacctccaaccccatgggtttcccatctccgttcttacccaagaagtcctggtcatgtcatggccacataagcttagtggaaaaaaacaccattgatacaactgtcattgtgaaagtatggaggtctggagtctctcataagcctgggattttgggtcatcagggcctatggccaccttacctgggctgagcttttggacaaggtgctgtgccagtctacacccctcagccagctgttcttggaggtcctgcccctgggacttgtccggctcatccggagtaaggagggcctggagatgctcattcaatgagcgggaggcatctctcccttcccgcaacttctcccttaactgggtcagctctcgttcctgagcgtgaaccaggactttatattgcctaaggtgagacggtagagaaaatttaagagtggaaaggttcagtgatccgctcaaatattgcaacagagatttctgagataatgtcctcaaggagacctcgaagcagaaggtcagcacatgtttaaaggaatgtctgtggccaagagaaagaatagaaaatggtttacaggcttcctctgtatcagagagggctcttgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcatcttgcggccactagatacaaagctatgtacagaaatgaggccaggtgcagatggggcgaattgaaaagacgaaagaagaaaagaatgacagggtcgagaaggcaacattgattgagtgaaagaatgagaagccgcagtcagtcaggaggtgattgtcactaagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccatacatttttattatccttcttctctgtttgataaatatttatgtgtagcgagcctgccatggcaattcctgcccttcccctggcccagcttagctcttacgtctccccaccgagctgctgtatttcagagatttacacacctgcccccctgcctgccaccatggggtcccctcacctgagctcctcagcttgcttgagctgctctgcaagcttctcctccttgaactgtcgctcattcctcagcatagattttatgaggtctttgcactcttcatattctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagaaagagaacctcaagggcacatcaaggaagttgacaagatgattcaaccacaacgaagtggagtcagaattcacagtccgtgaggtctgactctgaatgcggggccactttcccaagccttgcagcctctcctctaaaacactgcactggggcatgaagtagtgatttcttgtacagtcgggaaggcccctaggactatgggactgatggtttcccttttactgggaatttcaaggacaagtatgtgaaagatttttaaaatctttgatttttaaatcatatcttcagttatgattttaagaatcatatctgaagcataaagtgtgacacataacaccttaaggccatgaaggaaatatgcccaaatgttaataaagtttgtgttaatttagaaacagcagaatgaagaactaataaatagtgttcactgtgtgccaataaatgttctaggagattgacaagaaatagctcatgtaattcactgcagcaatttacagaggtaggtattattgtagtaccctctgaacaggtgaggaaactgagggacagacaagacaagcaacttggatggagcccaggagacaggcccactgtccctgctctgtacactgcactgttatctccacacattctcgggtgcgatctttcttcctctttagcaacaagactctgtgccccaggaagcaggacttcactctcaccaagctactctctgctttttattcttatttatcattattattattattatttttaccagtcttgccctgtcgcccaggctggagtgcaatggcaaaatcttggctcactgcaacctcagcctcctgggttcaaaggattctcctgcctcagcctcctgagcaggggtgattacagtcacctgccaccacgcccatctactttttgtatttttagtggagatggggtttctccatgttgcccaggctggtcccaaactcctgacctcatgatctgcccgcctcagcctcccaaagtgctgggattacaggagtgagccaccatgcacggcccctactccctgctcttgatgctgtcacttatagacagcacaggttctattaggagtagactcctcttgaagcccctcagagcaggtactggctactatcaccaagtttccctcagagtcactagaacagagctttgcctgttgggcctcaacagaaacttgaactgaataaaagttcactagtctcagacatttagaacaacagactagatgttatttgtctgcaggatcttatatggtagagaggattcttgaaaacacgattgagcctcttggagaaaacagatcattctgtgcctgtgtcagaaatcaataaatggcagtttaactctagtcccacccccatctgattgcaaacatggaaagttgctaaatactttggtacgtctgtcttccaactttgacaaaatgttaaaatacccatttctgttttcctagaagtatggggaggatgacattatttttgatggagagagcatttagtgtctcagaagacaggacatcattcatcactttcatgatggtgagcctatagatcttactgtatttcttctgctggttggccaggaagccggccagttgagttacaaaacatctctctttgaggtttctgaactgctgtttcttctctgccagctgggggtgcaatttctcattgatttctagaatgttcatctctgccttctcgctggacaaagggccggctgataccaccatgctgacgtttgtggcagaagaggtggggccagggactggggagaagaaaggcaaacacatgatgggttaaaactggtgaaatcaaataggcttaatcaggactgagggatgtcactggcagccttgtgtacttatttgaagatgatgtttccctggtttcactcttgtcatctccagtcttgatctcctttaagtcaacttgtcttagctatgcagtcaccttgaaaccaagacataaacacttctacacttttcttgcttatacgtttctataaagcaaggcttggccctgagatttttaccccatgagtagccaatgtttctgtgtagcacaaaagatttcattttgcttttttaatttttttcttttttggttttttgttttttgtttgagatggagtctcactctgtcatgcaggctgcagtgcagaggcacaatctcagctcactgccacctctgcctcccgggctcaagcgattctcatccctcagcctgccaagcatctgggattacaagcgccaagtaacatgccagctaatttttgtatttttagtagagatggggtttcgccatcttggacaggctggtttcgaactcctgacctcaggtattccacctacctcagcctcccaaagtgctgggattaagatgtgagccagtgcccctggtcacagacttacttttttttttgagatggagtctcgctctgtctcccaggctggagtgcagtggcacaatctcggctcactgcaagctccggttcctgggttcatgccattctcctgcctcagcctcctgagtagctggaactacaggcgcccaccactgcgcccagctttttttttttttttttttgtatttttagtaaagacggggtttcaccgtgttagccaggatggtctcaatctcctgacctcatgatccacccgccttggcctcccaaagtgctcggattacaggtgtgacccactgcgcccagctgagacttattaatagctaagacaagccaatgaaaaggagagagagtctagcctgacagaagtgaatgagggtgggaggatcatctcagcccatcctcccacctaagtctcctgagcagttgggactataggcgtgcagcaccatgcctgcctaattttttgtattcttcgtaaagatgggtttcaccatattgtccaggctggtcttcaactcctgaactcaagtcatcgtcccacttgggccttccaaagtgctgtgattatatgtgtgagtcacagcacctagctccatcctagtttctgactaaaacaataacaatatgtgtatatacagcctgtcctcagaattgatcttccatagcctagacagaggtatgagacacaaggaaaatagaggctacctgggagaatgtttagagcatcctgacattcatcatgagaggattctctgtctacaaccagagttgagttgacttcgtcttcctcaaatgtgattttgatgttcttgtgaggctggttggagtcacaagggccgtggctatttgaacaagtgatggcacattcctccagtgagtcctcagggactttgctctcttcagtcttctgcacctccctgatgagccaggtgggacagagatgacagaagattaaacacagagggattggaccccagggagtcctagctggttttgacagacggcattaagagagtggttccagaaagcaaaatggaggttcccttaaagagggaacaggcaatcctcttctctctgcaacagaccatggctgccacgggagccagagaggaagagagcagctggtgttcagtgcactggacagataggagctgaggaggatgaagactcagctatccctgtatggtacagacatgacacttggcacacatagagaaacacgacagctgccgcaccctgtgtctaagctgggttgaatttcacatactgtggccaagggaatgcgggcttttggcccaccatagatgccagagagggtgtgcctcctagacattttcatatgttaccacccattacatgctcctgagtattcagtgttacctgggggcagatgatttctgcactttctcagcctcctcaacttgaacatcttcatcctcatcttcgtcattttctataaatacaaaatgttcattcagatatttcccacttcacattctgcaagcacagtcagcccaacgtgcacagagacatgaacatctatgtatggttcagcattgtactgaaaactctcatgttttatctttcacaaaatgccctggcatggtttcctgctccatcgggcaatgcatttctgatgtggagggccaccatcaagatgtggccaaatactgaaaagaccttttgcttcccatatcactggaggcttgtgcagcctctctctggactttggcagctgtctcccccatcctgccacagatctgattcccaggaacaggcttggtgtcctgtcacagttcgcatttcaaacctcattctttctcttaggagaggacaaacttgtcccacagtcctctatgcatcatgagactgcacaggccctccatgtggcttctgctgtgttattcagggacattctatccatggggagtgctccagtctgaagcacttcctaccaccaaatgaccccacatcaagtgccttctccaacaccacatggagaggggcttcatctcattttgaaaagcattcgtaagtgttcccatatttggatgcttcagacccttgcaagagacaatttgtctgcctttgtagatggagagagagaaactctggaaagataaatcactcactcaccgacacttactaagaacattgccaaaaagacagcctgggaaccttcattcttagcccagaactcttttcactccaacaagcgccctcccatcacagcctccttcctgtcctttaaaactagatagatgctgcctcttgctccaaagaccaccttccatcaaggaaggagggacacttgcaatactgtgatctccaaacccatgggtttcccatttctgttcttacccaggaagtcctgatcatgtcatggccacatatgtgtagtagaaaaaaaccccactgatacaactgtcattgtgaaagtatggaggtctggagcctctcataagcctggggttttgggtcatcagggcctatggccaccttacctgggctgagcttttggacaaggtgctgtgccagtctacacccctcagccagctgttcttggaggtcctgcccctgggacttgtccggctcatccagagtgaggagggcctggagatgctcattcaatgagcgggaggcatctctcccttcccgtaacttctcccttaactgggtcagctctcgttcctgagagtgaaccaggactttatattgcctaaggtgagacggtagagaaaatttaagagtagaaagggttgagtgatccgttcaaatattgcaacagagatttctgagacaatgttctcaaggagaccttcgagcagaaggtcagcacatgttgaaaggaatgtctgtggccaagagaaagaacagaaaatggtctacaggctttccctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcatcttgcggccactagatacaaagccatgtacagaaatgaggccaggtgcagatggggcgaaatgaaaagatgaaagaagaaaagaatgacagggtcgagaaggcaacattgattgagtgaaagaatgagaagacgcagtcagtcagaaggtgattctcactaagggtaagtggggtggcgatagcacaccattttgattatactgaatgctgctgggtggttcccactcctttggtgaattttgtgttatgtaaatttcacatcaacaattacttgtttgaaaaagagaaaacaaggctctaagaaacaactgcaacacagaacttattattatccttgttctctgataaatatttgtgtgtcatgagcctgccatggcaatttctgcccttcccctggcccagcttcgttcttatttctccccgccgagctgctgtacttcagagatctacacacctacccgcctgcctccccctacggggtcccctcacctgagctcctcagcttgcttgagctgctctgcaagcttctcctccttgaactgtcgctcattcctcagcataaattttatgaggtctttacactcttcatagtctgagaaaagacagacacgcctgcctcagtggaaggctggacatgctgctgtggtcactgcctacagggcaggagccaggtccatcccaaggacaaaactctccccagtaccagggtctagacagggatttccacatctttactcttcagtctcctgactttctggcatctgatcctccaaaatttaaagatgaagaaagagaaactcaagggcgcgtcaaggaagttgacaagatgattcaaccacaacgaagcggagtcagaactcacagcccctgaggtctgactctgaatgcggggccactttcccaagccttgcagcctctcctctaaaacactgcactggggcatgaagtagtgatttcttgtacagtcgggaaggcccctaggactatgggactgatggtttcccttttactgggtatttcaaggacaaatatgtcaaggactttaaaaatatttcatttttaaatcaatattcagatatggttttaagaatcatatctgaagcataaagtgtgagacataagacaataaggccatgaaggaaatatgcccaaatactttattagtatgagaggcagcattaagatttagattagttgtgttaatttagaaacagcataagattagtttgtgttaatttagaaacatcagaatgaagaactaatagatagtgtttacactgtgccaattaatgttcaaggagattgacaggaaatgcctcatgtaattcattgcagcaatttacagaggtaggtattattgtagtaccctctgaacagatgaggaaactgagggacagacaagacaagcaacatggatggagcccaggagacaggctgagggtccctgctttgcacactgcactgctgcttccacacattctcgggtgtgatctttcttcctctttaggaacaagagcctgtgcaccaggaaacaggacttcgctctcaccaagctactctctgctttttatttttatttttgatttatttatctttttgtttgtttgttttttgacgagtcttgccctgtcacccatgctggagtgcaatagtgcaatcttggctcactgcaacatctgcctgctgggttcaaaggattcttctgcctcagccacccgattagtggtgattacagttgcccaccacgacgcccatctactttttgtatttttagtggagatggggtttctccatgttgcccaggctagtctcaaactcctgacctcgtgctctgcccgcctcagcctcccaaagtgctgagattacaggagtgagccacgttgcacggcccctactccctgctcttgatgctgtcacttatagatagcacaggttctattaggagcagactcctcttgaagcccctcagagcaggtactggctactatcaccaagtttccctcagagtcactagaacacagctttgcctgttgggcctcaacagaaacttgaactgaataaaagttcactagtcctagacatttagaacaacagactacatgttatttgtctgcaggatcttatatggtacagagaggattcttgaaaacatgattgagcctcttggagaaaacaggtcgttctgtgcctgtgttagaaatcaataaatggcagtttaactctagtcccacccccatctgattgcaaacatggaaagttgctaaatactttggtacctctgtcttccaactaacaaaatgttaaaatacccatttctgttttcctacaagtacaagaaggatgaaattatttttgatggagagagcatttagtgtctcagaagacaggacatcattcatcactttcatgatggtgagcctatagatcttactgtatttcttctgctggttggccaggaagccggccagttgagttacaaaacatctctctttgaggtttccgaactgctgtttgttctctgccaactgggggcgcaatttctcgttgatttctagaatgttcatctctgccttctcgctggaccaagggccggctgataccaccatgctgacgtttgtggcagaagaggtggagtcagggactggggagaagaaacccaaacatatgatgggttaaaaactggtgaaatcaaataggtttaatcaggactgagggatgtcagtaactgaaattcttaccttactgttgtgaaaaatgtgatcactccccacagcactttaggatccttcaccacaaaaacaaggttcaaggtgcctcaactcagagctgaaagcactgccagtagctcagactctgataagagtgaggtagattgtggccagcgtgccaggtaaccgtctgcagttgcaataacagaattagaaggtgggggtgtcatggaatcttaggagccctgcattccaattgcccaggctttgctgaaacacaggcaccctagtctcacctgagggtcaccaccaatggggatcattccttcagcattcactctcagtattcgtgtacccttgtgacaatgccacagacccgtgtctttcccaatacatctaagcatattcctcactgtttatctcttgtctgtacaacatcatcaaggcagaaacagtttcccaacaggttatattttcttaatggtagtcatgaagtcataaataaaaaaatggaatcatttagtatgttctcttgttttgactttttctttttttttttttggagacagagtctcactctgtcgcccaggctggagtgcagtgacgcgatctaggctcactgcaagctctgcctcccaggttcacgctattctcctgcctcagactcccaagtagctgggaatacaggcacccgccaccacgcccggctaatttttttttttttttttttttttgtatttttagtagagacggggtttcactgtgttagccacgatggtctcgatctcctgacctcgtgatctgccgcctcggcctcccaaagtactgggattacaggcgtgagccaccgcgcccggccgacttctctttactcaggtgggtatatatgccactaatttgtttgattgtgtttttcccttgtttcattttgttttggccaagtaatatcctattgattgtatgattatcacacaattttatatccatttttctgatgggagacaggtttacttgataactactgtgcataagtaactatgaatattctcatacaattatttctgtgaagatacatacttattttcctgggtatctatagctagggatggagttgcttggtgaatgggtagaaaatgttggacagagttttgcaaagtatttgtattgctttacatttctatgaaagatgtaggccatttccagttgctctacattcccacacacttaatattttcagtcttttaaactatgccaggtgtgtagtgatatcataaaatttggttttctcatgcctaatgttcatttagatatcttcttatggaaaatatcttctcaaatttttatattcattgatatactgggctgtttgtcaatttctttgtaataggagttctttatatattttgaatgagtccatttatacatacatattttttgctgtattatatagcaaataattattcctggtctagagatagcgtttaagttgttaaacaacaacataataaggagaagctttttaaaaatgaagtgcaattcgcttgatttcttattgtggtgagtgctacagtatctagtctaagaaatattttcctgtgtcaagttcatgaaactatttcctatttttcctttacaaggtttctaattttaactttcacatcttaagataatttcaacatatgatggagagtggttaatattaactttttaaaacaacaaatattatttcactcaaaatcgttttacttaaaagtctttcatttccccaatgaagggcattggtgtctttgtttttaaaacatttagaagcggcggtgcgagcatgttctcactcatgggtgggaactgaacaatgagaacacttggacacaggacggggaacatcacacaccagggcctgtcatggggtgagggctgggggagggatagcattaggagaaatacctaatgtaaatgacgagttaatgggtgcagcaaaccaacatggcacacgtatatatatataatatatatacacgtgtatatatattatacacatatatacatgtatacacgtatacatgtatacatgtatatacgtgtatacacgtatatataatatatatacaaacacatgaatatatataatatatatacgtgtatatacatacgtgtatatatataatacgtgtatatacataatatactatatataacacgtgtatatatatattatatatatatatttttcttttttaagtggcggagcgagggctactgcacagctagcagagtcgtggcgaggaggacagcacctgcatcgagctctccgcctcccccacccgccagcccaggcggccccagcagcagtgaccagaagagcccctgcagcaacgcaacggccaggtggacacctccatctacagcctcgtggcggacgggacctgttaggacacggccattgtgggcaacaaggacccaccttccatctgggccgccgtcccagggaaaaccttcctcaacatcacgccagctgaggttggtgtcctggttggcaaagactggtcaagctttgtcatgaatgggctgacactggggggccagaaatatactgtggtcctggactcactgctgcaggatggggaattgaccacggatcttcgtatgaagagcatcggtggagcccccaccttcaacgtcattgtcaccatgactgccaagacgctaggcctgctgatgggcaaagaaggtatccatggcaatttcatcagcaagtaatgttatgaaatggcctcccaccttcagcgttcccagtactgacctgctttgttccttccactccaccgctccccacagctttgcctgcctttccttcacatacacacaccattttaatttcaggagtcattaccccacacaccttattgctgccaaaaccacatgggctgggggccagggatagatggacagacaccttcccccacccatacccctcctgtgtgtggctggaaaacttttttgttttgatggatttcttatgaataaaaaagattctactaaaaaaaatgaataactgtacatatgtgggcatattgtttgaatctgtattctttcactttgatatatttatgaatacttacaccattactactgttttaaaattactgtagctttaaaatcaggtttgaaatctagcagagtaagtcctccaacttattgcttcttcaagaccgacttgcttattctaggttctttgattttcaaatacattttgaaactagctttcaaatttctctaaaatctcctactagaaatattaatcagaattgtgttgatgtaatatgctaacaaaattgagtcttccaatcaataaacatgatatatatttatttagccttaatttttctcaccaattgcttttaggggcctcgtacctgcttcattgcatgtattgttaagcatgtaatgattctggttattaatctctattatgttttattgaatttcattttctagctgctaattgctagtatggagaaattaagatgatgaaatcaactttataaaggcataatttcggtacaacagactgcaccactttaaaatgtgtaattcaatgcacgtttacaaatggatacactaacggaactactgccacaaccaagatagaggaaattccctatgccccaaagtttcttgtacccctttgcagttcatcagcctttcaaccctcagccccaaggagccactgtcacttcaggtccgtttgcatttttaaccattttctataaatgaaatgatacctgtgttcttttgtgtctgccttctttcatgcatcaatgtaattttaaaatccatctgtaatgtctcgtaaatactgagtagtattccttcgtgtggctataccatgtatgtttgtactttcacttattattggacatttctatcattccgcgtttgggctattatgaagaaactatcatgagcatccatacgtggcaggccaggtctcactaacacaggcctccctaacaactgtttcagtaccgactgagtggttcaattaaatattaagaggaaaaaaaaaaaagaagccagtgcccttatacaaaggctggaatgtaacaaaagcccaccaagagttttgcctaggtttttcctgggccttaaagcatgacgaaataacgaaggcattcttaacaggagccatttagtattaaacgagttttattgggggtctgaagaaactccccaggcctccacaaacaagtttattggagatctgaagggactctccaaacctctgtgatttagcaggagacaagataagggcccccagcacctagacccatttagattaactgaatttaactgaggttccagaggaaggtcttcaggactcagacttatagattaaaagaagttaatcatttatgtatttagatgaatgcacacttccacatacacatatagcttagaaggtacattagctcaggaaaactttccaattttgagttggtctggtgataatttccaggccgtttccctgtaaccagttgcagaagtcaaaactctcttcctccccagttcatctgtgtctcgttacggagccacgagaaacagcatcccgcccctcaggttggtctggaaacacacatacagatcattgtgcagacacagtgtgtaaattcctaggaatggaatgactgtctatctgatttgtgttacgtttaacctttaagaaactgttagattttcaaaggagccataccatttttcattcctacaagtataagacttccaagtgctttatatcctcaccaacaggtgctattttcagcctttttaattttagccattcttatggatatgtactggtatctcattgttgcactgattgatctccctgatgactaaacagtggagcatcttttcctatgctaattgaccattcatgtatcttctttttttttttttttgagacggagtctcgctctgtcgcccaggctggagtgcagtggcgggatctcggctcactgcaagctccgcctcccgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggccccatgtatcttcttttctgaagtatctaagtcttttgagaaattgtttcaatgtgctgtttatcttatcagactgcaatatatatatatgtgtgtgtgtgtgtgtgtgtgtgtgcctgtctgtgtatatatatatacatatatatatacgtatatatatatatacacacacatatatatacgtatatgtatatatatacgtatatatatatatatatattccctatttggagataataatcttcaaaacggtgaatatatatatgtatacacacacacacacacgtttgtgtgtgtgtgtgtgtatacatatatatatgtcctaagaatcaattagacatacatgtgagtatctatttctggattctctcttctcttccactgatatatattccatttttttttcaacaaaacacataatcttgattttcatagctgtagagtaattctggaaataggtagtgaattcattcaccattattcttttataatattgctattttattattcttgatcattgacattaccatataaatggtagaatcagcttgtaaatttctaccaaaatgccggttggaatttttattagaattgcattggatctggagatcaatttacgaagaactgactttttaaacataacaactcttctgatccatgacaaggtttatctccccactaatttagttctttcataatttctcaaagcaattttttgtagtttttggtgtactggcctactggccttacataaattttgttgactttcctttttttttttttttttttttgagacagagtcttgctctgttacccaggctggagtgcagtgatgcgatctcggctcactgtaacctctgcctcccaggttcaagtgatcctcctgcctcagcctcccaagtagctggactacaggcacatgccaccacgcctagctaattttttgtatttttagtagagatggggtttcactgtgttaggcatgatggtctccatctcctgacctcatgatctgcccacctcggcctcccaaagtgctgagattacaggtgtgagccacggtgcccagtctgttgaatttatttataaacacaacatgtatttagatgttactttaaatgaaattgtattcttatttcattttccaaatgctcatgcctttctaatttgacataaagtgctacatggcattggggctggtacagcctcgctcaattatgggttgaagagtacacagagactgccaggctgagggaaggtgcaagagaatagaagagatgctcacagagaaccacagaccgcacggccccagagtcaggggcagcatcagccactgtcggctgctcatttgtccagacagagcccacaagcctcagccatgctttgcttctgcaagatgcttcttcaccttttcaataaacctgcctgaattaaagctgatgggagtttatttctccttcatcataaaagaaattcttcaccacaacaatctccaatgaattgtgggcacagaaggcagacccatccctgcttctcttccactatctcccctgtaggttgaaaaggaggaggtactgaattacctccaaatgttcctctggctctgatattctgtgactctggtttcttttcggctactttgtttttggaagcatgtatcctaaggcgtccagttgaaaaacctttgtctactgtgtccagacattcctggtggtatttcagattaagacacccttgggttgctgcactcacaaccactgaaccaattctatgaccatctgtttcatggccacctgtttgctcattttctatgtacataaagggaggggacacaacaaatttgcatattataaactgtatcatcttaaaaaggaaacaaggcaatattttgcaataaaaccttaagatgcattaaatttaagcctaatgcagtaaagaatgcccataaaattattatctaaagaatgtttagaaaattgttgaacaagggacatcatcatttaaagtgatacgaagaaaactcagctaagcatatgggctagattagagagaaaaataaaggacccatctctgccctggaaaaactactggtagcatctttcacaaagctctctgtgtttgagtacgcaccttgatccataggctcacatttgatcccaactggcggctgcttcttggcattaactttggattcccaaccagtaaatcttaccaagatctgagtttctccaggtatgatattattttgtttgaccatccttatcttcaagggctaccaagaagaaacaaatcatttatttacctccccagaggaaaaggttttaccaatgagacactttcttaccatgaccccagggcccccatgccctgttcacttgagtgccctgtgtggcctgagagaagctcatactggtcacaggattctttatatgattaacctccttcctgaatcccaactttatggtggtggtgatgacaggtatcccatgctcatgtccctgaagtcatcagcctgtctccagttagaaaaaattacatgtatatagagaagcctctttggaagtagcaaaagctttctcaccttcatacattaatggttggaatgtacaatagtataaacactttgggaaaaaatgtctggcatattcttacagaactaaacaactacctattctatgactcactaattcctaagcatttatccaagagaaattaaaacatatgtccagaaaatgatttatacaagaatgttcatagcagttttattcataataggaaaaactggaaacattcaaatatctatcaatacaagaatggatcaataaactgtgatacattcattccatggaacggctaaaggaacaaacttttgacacacaaaacaagatggatgaatctcaaaaacattttgagtgcaataggagccatacgcaaaagagtgtgagaaaaatgataaataataatggtttcaagaaatgcagagcagagagcccagaggcaaagacccacaggacagagggtcagtcccaggctgtggatcctaactaagaaactcctgctggattttgcccagctccatttccaaactattttgggttattgacttctttatcccctccatgttccctcattttgaactagaatcactgtagtggttattctatgtctgtcccatcatttcacattaggggcagataagctgtttgttcagtttcacaggtcgacagaggtaagggaattatgtcaaggatctgcacttaatggacactctcggaagcctcattcacacctggtgtggatgttttagatgggattttaaacttttgatctgatgtggtctacatgacatttttcatgttgaactaatgctttaatgacatgaaatctggaaacctcaggggagagggtaaatgcactttgcagatgggggaatgtgagtgtcctactgtggtagatggaatttctgaaatggtccccaaacatgccacacccttgtctctaaagcctcttaaggtgatgagacaccattcctgtgactatgttgttatatgccagttatatgactttaagatggtgaggttaccgcatgaactggatctaatcacatcactccatacatgacagagctttgtgtggctggttggagaagatgaagtcagagaaggtgggagcttgagaaggactccatgagttgttattggttgaaagatgaaacagacaggtaaggaggaaagcatgtggcctctggagtcagagtagactgtctccccgctgacagccagcacagaaaaagggccctcagtcccccacaaacaagaataggaactctttcattatctgtagtgaacctggaaaaatagcttgagctctaggaaaaaaacacagccagcccattcccggattttagcctcacatgactctgatcagagaacccggccacttcattccagacttctgtggtttcaaaccactggtttgtggtaatgtgataataggcagcaagagaaaactagtacaggtgcctgtctctcctcttgaatttcaatttcagataaatgtatgctaaccctctaagagaaaaaaatcaatcaaccaatcaatgaaagaactacagtaaaaatattgccctcacctttatgtggctgttccagagcccttgccacctgaagaagacaatgaggggtatttcaggcacttgaggagtgtggctttactgttatcaatcacatttctggaagaataaaaatggttcagtgaagggatgggttgcccctccacacctgtgggcgtttctcattaggtggaaggagagacttggaaaagaaagagacacagagacaaagtacagaggaagaaaaatgggcccaggggaccggcgttcagcatacggaggacccatgccggcactggcctctgagttcccttagtatttattgatcattatcgggcatttccggagagggggatgtggcaggacaataggataatagtggagagaagatcagcaggtaaacacgtgaacaaatgtctctgcatcataaacaaggtaaagaaaaaagtgctgtgcttttgatgtgcatatacagaaacatctcaatgccttaaagagcagtattgctgccagcatgtcccacctccagtcctaaggcggttttctcctatctcagtagatggaatatacaatcgggctttacaccgagacattccattgcccagggacgagccggagacagatgccttcctcttatctcaactgcaaagaggccttccttcctcttttactaatcctcctcagcacagaccctttacgggtgtcgggctgggggacagtcaggtctttcccttcccacgaggctgtatttcagactatcacatggggagaaaccttggacaatacctggctttcctaggcagaggaccctgcagtcttccgcagtgtagtgtgcctctgggtacttgagattagggagtggtgatgactcttaacaagcatgctgccttcaagcatttgtttaacaaagcacaccctgaacagcccttaatccatttaaccctgagttgacacagcccatgtcttagggagcacagggttgggggtagggttacagattaacagcgtctcaaggcaaaacaatttttcttagtacagaacaaaatggagtctcttatgtctacttcttcctacacagacacagtaacaatctgatctctctttcttttccccacagttcaggtcaggccgtggctcgtgtctgtaatcctagcactttgagaggccaaggcaggtggatcacttgaggtcaagagttagagaccaacctggccaacatgaagaaaccctgtctctaccaaaaatacaaacattagccaggtgcggtggcaggcgcctgtaatcccagctattcaggaggctgaggcaggagaatcacttgaactcaggaggtggaggttgcagtgagctgagatggcgccgttgcatttgagcccaaggaaaagagaaataactccatctccaaaaaaaaaaagataaaataaagacggttcactacttaactccaaatattattatgtgaaaatgtatcatctcaattttaatagcagattttaaaaaattccttttcttgtgctcaccagacaaggtttggtaacaaataccagtcaccagcacagatgaaccaattcaaggagagccataaacaggactactattatgtttccccaaaaaccatccctagaatgcaatctcttctctacttgtcacaaaacgaacacaatagtccactatataaagtcccaaacacaggaaaatgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattaacaatgggggacttttataacaagtaattctttaaacaaacttttgggtttctatttcaacatggaaagagctaggcagtcatcacttgtcctcacagctagaaaaaggctgaacaaactgaaagtcaacccttctagggtggatcagagaattgaggtcacagggaaaactgccaccttaaaaatgagaaacacaggctaacacacaaggagtcacagctcacagggaagagaagctactggggacagcaagtgggaggagcacttaaatggtattgacagattactagaagctgagggtagcctggctagaacattaaaaactccttgaagaccagactaagggggaatctcacacatttccaagtgttactacaatgatctcaaccaggttctcatgatgaagttcagaaaaactccctgaggtttggcactaccaacttcaggacttacattaagctacagtaacccaaatagtgtgaagttggtgaaaagagaaaacacacacatatagatgcatggaaaagaatacggagcccagaagcaggcctacatacagtccactgatcttccatggaggtttagagacaatttaaaacagcaaagatagcctttccaactagtggtgctagaacagctggacaaccacatgcaaaaaaaataaataaatccaggtatgcatgttatataccctttataaaataaatcttacacgtaaatgtaaggtgcaaaaccataagaatcctaagagataaaataggagaaaatctgagggatcctgggttcaatgatggcttcttagatacaaaaccaaaagcacaatctactaatgaaaaaaaaattaagttgagcctcattaaaattaaaaacttctgttgtgtgaaagacactgttaagagaatggaaaaagcaagtcacagactgggagaaaatatttacaaaataatctgatggaaaaactgctgccaaaatatatgaagaattctgagaactaaacaacacaaagcaaaaaaaaaaaaaaaaaaaaggtgaaagatctcaacacctcattaataagatatacagatggcaaataagcatatgagaaagatgctcaaaatcatttgttgtgagggaattgcacattaaaacaacgagatatcactgtaaacctatcagaatggctaaaacacaaaacggtgaacacaccaaatgctgtcaaagatgaggaacaaccagaactctccatagctagtggaaatcaaaagtgtacagtcactttggacaacttaagttcattcaaaatcctgcacataagtacttgcagcaattttatcataattgtcaaaacttggaagtacccaagacgtctttcaccaagtgaatgaataaacaaactgtgttgtagccatacaatgaaatctgattcagtgattttacaaaacaagctgtcaagtcatgaaaagacgtggaggaacttaaagtacataatgctagaaagaagccagtctggaaacctacatactgtaattccaactctaggacattcttggaaagtcaaaaagatagaagtagtaaaatgatgagtggttgtcaggggtggaggagaggaggaggcacgaaatggtgaagtacagggaattttcagcagtgaaactattttgcatgatgctgtattggggatttaggacattacataattgccaaaacccataatctgtgaaactcaaagaatgaactctagtgtaaactatggactttagttgataatgatgtatcaatagtggttcatcaattgtaacgaatggaccacactaatacaacatactaataggggaaactgtgtgctggaggacaggggagcctaggagaactctctgtactatccactccatttttctgtaaacctagaactgttctaaaaaataacatctattacttttttttaattaggatgcagcagccccataccaaggttttggtggcatcctgttattgtgtggttagtacttggcattgaagtgcaccaacctggagtcagagcagttggagatttcaatgcctgtgccatttacctctaaccctggggtgcccccggaacacagatagcagatcagttaggcagaagcagcctcagtcatctagacagtgcagggttctggtaaggacaggtgcaaaccatctaggtgggcagaacttggtgatgactaggaaccactgagactcagcagctgccccagtggcacccacaaatcagaggaggaggaggctgggaggacctaagggctacaggacgagctccctgcctacaagacagaagcagctccagaggttttggtaagtaatgtagatttcagtgcagtgtggtctatttaaaaaagtagaacaaaaaggaaagaaaaagagagagcatgagagacaaagaaaaagaaaagaagaaaggaagaaaggaaagaatggagggagggaaggaaggaggaagggagggaggaaggaaggaaggaagggagggagggagggagggaggcagggaggaagggaggaaggaaggaaggaaggaagggagggagggtggaagggaaggagggagggaaagaataaagagagagagaaaaagagtgggagagaagtagggaaggagagaagtagggaaggaaggaaggaaatgaacaaatttacatgaagatgagaacatccaggggaacttacaccaccagtattttccattaacaggaacacgctaactagttattggagacagacgcactactgtaaaactatatactgtttccatggggtacaaccccttcttcctcctctgaaacacataattcctctggcccactgttgccagagacactgagtcttgtctttggataagttctggtgcccaaaagaatgagatgagacagtggatcccagaacaccaggccgcaacctttcctgctgctccttgtccactccagaagctgcccagctgcaggtgggggcctcagcccctgggtctgacatcgtccatttgtcattctcactggacttccctcctcgcactggctcccactcccccaggacctggtggacggccacgtgagaaggatacaaacaggccatgcccctttctttctccccctctcaatgcctgcagtggtgggttccatggggtagtgacctgagatttactcattatggggtctctagcccagagcagggcatggtacctaatagtcaccccatgaatgctcagtgaaagaaggcgtccaccacaaggtcctggggaaccaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcctattttgaactggcattttacagtgccgaaaggatgttggagtgtttgtatacaatgggagcaaagaagattacatctagaacatgggcaatttactggagctccttaattcactagtgtccaaagataatggttagtgggaaactgtagctgtaaaggatttgcagtctattggaatgaaaattttggtcatactactagtttaaaatttctgatagggaaaggtgttggtagaaggtaaagggagcattgataggtgatttgaaaaaatgaaaaagaggagctgactatcaacatagaacatagaccaacagcagaggcagaacctatatcagatattgtttacttgtgctgattaatgccttccttccctttatcatgctgcctgatctgaagagtactggtggaactaacattacaacctaggttccaggtaggggtatgactgagttgataccagcccaccaccatacagtggcaggtgccctttgtaagtaaggaggatagtaaatgttatcctccttactctaccattgcactgctaagtaggcttttattttgctgtatttgccacctttaaaatttatccttcgcatcgtagtcataacaagtgaggtaattaatgaggcttccttaccttcactatctttcttcacctttgacatggtaaagtttattatttctatgttattggggcatatgacatttccagcctattctgtaaccctaatccacatttggtttcagtctacagtaaaatacattcaatacttacaactttttttttttgctgtattttaccaaagcatcttcctttaattggttgttattgttttccttccttctgtaaccaaatgtattgccctttttctccacatacccatgtttttgttctctcaaaaacattaatgaaaatattttttcctgaattcttgcttgataaaaaccgcaacaaattgtaatatatcatgtctgcatagtaagactagcttggctgcacataaaaatccttggttggcattgagaatcttgttggtcttccctcatgaccatccagcttcagtacagctaggggagccaggacagccttcttcatttctcctgtgagtgacttattctttttttctggctgcccaatagataccttattttttttaagtccaataccttcattaagatgtggttcactttttgcctgtcatgaatggatataccttgcttctgatgtgcccttttgaaaggtagattcaagtcttcatgcattgcatggaagtgttcttgaattataattttgaagtatttgttctgtctcttttggtttcttctttggatgttccagtaatgtatgtgttcaatccatttgtcggtcttccatagttctcattttctctgtaatacttgagttttgcttttcagatgtttgcttagataatttttgtataaatgggtatctatttccttttatttttgtaatatactactaaatggtttgggttttcctagataactacagaggttcagagagagaattaagacaaccttctgggcctcacaccagaatggctctttcctactgggctgtcacagagacagactgcttcctgcaagtatggctcctctggtgattctctgtgtggttgaatctcccttgttcctcccttgaacaaaactgggtccaggaggggactttttctggtagactgtgtaccctggttcccactcctgtggttaaaaaaaaggggtataagttttgaacatggaaatgaactcccaaattttcagggagtacattttgttggtgttttctgagattatcagccattggcctcactacctccatacttcatttactcccatgtggcttgtgcctgattccaactagatttagtcatccctacataagttttgaaatctttggattctaactttttctagtttcactaaggatatatttggttctttttttctccattttccttgttgcttttttatgtgttctggaataacatgaggaaaaatgctgacttttacagcctgtgtatacaactacctctacagaaaattttaagatatatattagttctttatattcacacaataactttgcaaatagtcctagtgtacaaagcttattccgatatcttgctgtgtttttaaacaaacatatatacatatatgctgtgatagctgatgttgagtgtcaacctgattggattgaaggatgcaaaatattgttcctgggcatgtctgtgagggtgttgccaaaggagattaacatttaagtcagtggattgggagaggcagaccctccttctatctgggtgggcaccatctaatcagctgtcagcacagctagaataaagcaggcagaagaagatggaagaacagacttgctgagtcttctggctttcatctttctcctgtgctggaagtatcctggtctcgaacatcagactccaagttcttcagcttttagactcttggacttacaccagtgatttttcaggggctctcgggcctttggccacagactgaagactgcattgtttacttcccaactttcgaggtttcgggactcagactgatgcaccactggcttccttgctcctcaacgtgcagatggcctatcatgggaatttatcttgtaatcatgtgagttgattctctttaataaacccccttttatatgtacatctattctatcagttctgtccctctagagaaccctgactaatacacatgcatacacacatgtggtcatgcagacatgtatacatgcatgcacacatatgtgaccacatgaacatgcatacacatatgtgatctttgccattgtggatggctaggatgatttttctcaggaaaggtatctgtgttattagaaaaatagccctggttctcatcctaaagtcataaaaatcaggaggtaactcagtaaaaggagacacacacacacacacacgatgttatatgtataagtgatttaatattttatatatataatcaaatccttgaaattgccctttgtattaatcagtgttctttatagaaacagaatcaagagtatatgtgtgcatgtgcacgcatgtgtgtgtgtgtgtgtatatatatacacatatatatttaatacgtgtgtgtgtgtgtatatatatatatagacagagagagagggaaagaaggagagagagggagtttattataagaaattggctcatgtgattatgggggctgaaagtctcacaatctgccatctgcagctggagacccaggaaagacagtgatgtagttgagagaaccaaagtatcgatggtataagacccagtcaagaacagcacagggggctgatgtgtcagctcaagcagttaggcagagggtgaagtcacccttcctgtgctttctgttctattcgggtctcaatgaatcggataatgcccactcacacggtggagggccacctgctttactcagtctgctgattcaaacgctaatctcatacagaaacagcttcacaggcataaccaggacccatgtttagtctgggcacctcatgtctaagtgaatttgacacaaaaattatccatcatacccagagttcttaatcaaagtttcaatgactgaggccagtcctgggcagctaatgttcgtccaatattgcgtctagttttaccatcccttccgtttgccagaaatagaaacagaaaatgttctacatgtttgcaccaccaaataatgaataagcaatcaaatgccattttgattattgaccttctagcttttacaaaacacaaaacttgcacaaataaagatactattggaagccaaggaacctagagacacatgtaaattctctttatctctgctcgatgcgtaaagtattcttatttaagagtaaatttcctcttgtttcagtgaaagatatttttaactgatatttttaccttcagcaaacacataaacggtgaaagttatcccaaacattgccattttcaatttccaaaggagcttatgctaatttcagaggcatctctatggtttatatgtatatttaatatataaggcaggtcctactatctctattttacagaagaagaaactgaagttggaaagatcaacaagcttacctgaagtcacagggcgggagagtaaaggagcagaattttcaacctaagtttatatgattctaaaattttccactaccatgctactaaaagaaattactcaactagttcttcctgttcaggtaagtcagttcagactttgctaattctgaataaaggggacagaagttatgatgctgtaactatttgacatagactgtgttagattagagatgagaggcaaaaatctgaccctagtatatttgctttcattgattccaatgtcatctttaggtttttgtatatttctttctgattttaacatatgatcctttattttcttcttactttcctcccttcctcctctctctgtcaaattgttttcctcttcctcctcttttaaaaattctcaaaatttgactataaattgctttttcttctttgctccttttcacaactctttcattgccacaaggcattcaggtagaaaaaaaggccaaggtagtctgcagtgggctagctatttacccaattgacccaccatatcttttacataagcaaataaattaacaagttatgtaaataatttatattcaaatattcagaaatgtcttagacatgtttaacatgctaccagtaaactccttttaggaggagaccacatgcagctttagaatagaaaatagaagaaaggaaaaaaataaacaaatgaaggtttttctctgcagtctttatgcaagcaacgacttatttcttaaactctcccctttgtggctatcactcaaagaaaataaagaagaaaagctactggctttctagtttaaatcacagtctcattattctgtaggtgaatggggagggggattggaatcgtaggtccgagtgggcagtaacttgaagtcaatggagatatttacaaaacagaagcacaatcacgatccagcagttctggagctgctaactttttctgcctttttctaaatgtccaataataaggttctaatggagactgaagatccatcacctgctccacatctccagggggcccatgtgtgcatcgcagtgcagatcatacatgcttctttcccctcccatggcaaggggaatactgaatgatgacaactcacatgtgtaacccaagggctttgcttgggtttgcaaggactagtgcacaatacattctttgagtgttataataacattaagtcaatgcacgaattataatccctatttcacaagtacaaaaacacattcaaagaaattaacttccttgctcaccaaacagttattgacaaaaattacaatatttatgtttcttttgaaaaatattataaagattctcaaattgtctaaccaatcatattatccgtatttgtctcttctcaagctgttaataaagacatacccaagactgggacatttataaaggaaaaaggtttaattgactcacagttcggcatggctgtggaggcctcaggaaacttacaatcatggtagaaggggaagcaaatatgtcctttttcacatggcggcagcaaagagaggtgggaaaaaggagggaaaagccccttataaaaccatcagatctcatgaaaactcacttactatcaggagaacagcatggaggtaactgctcccatgataaaatcaccttccaccaggtccctcccatgtcaggtggggattatgggaactacagctcaagatgagatttgggtggagacgtagccaaacatatcgttatcttgataagatattgctttggattgaatcgtgtccctgcaaaaatcttatgtataaaagttctgatccctgatgtgactgtttttgaagacaggcagggcctttagtaggcacttaaggtcaaattaggtcatacgggtgggacctcagtctactaggactggtggctttatactgaaagaaagagacagatgtctctcccctcgacctcacatgtataaaggccacataaggaaaaagcagcccaagccggtaagaggccccaacagacgccaaacccttccagcttcatgatcttggacttcactgcccccaaaactgtaagagaatgaaattctgctgcttatgccatccagtctgtggcatttagttacgccagcctgcactggctaatgcagatattcagaatcaaatgagtcatcccaagcaatttctcagtatatacagcacagatttcaccttctaaactcacccttgtcttcgcctttttttttttttttttgagacggagtctcactctatctcccaggctggagtgcagtggcgctatctcggctcactgcaagctccgcctcccgggttcaccccattctcctgcctgagcgtcccgagtagctgggactacaggcgcccgccaccacgcctgactagtttttttttttttaatatttatatttttagtagagatggggtttcaccgtgttagccaggatggtctcaatctgctgacctcgtgatctgcccgcctcggcctcccaaagtgctggaactacaggcatgagccaccacacctggccagtttttcttaattattaaataatctttcactgatttaagaaatattttcatatggttcctattcaggcccaggcattgtttttttgtgctgcagacaatgtgttaataaaagctgtccagccttgttagtacatcatgatatttatatttgacaaatcctctacttagatatgtatcacctccataattttttggaacacataaattttttgaaccaaatggaataaaaagctagatatatacgtataatgaatatatttgaaactttgtactttgctttacaatttgcaaaagaacatcatatacagtgttgtatttgagtctcccttaagccctattaagaagaaatttttctatttctgctgttcagtgaagaaaatgagcaaaaaaaggtgcagcaacttcccaatatcccatatttacaaacataaaggagtgggactttaaggtagactcttggtgtccacgtttgtgctctttatgcttcatgacaccaggtaaagtgcaatgagcacagcaaatgtgccccctcaggagccagctaagaccttccgggggcttctcctggaagtacagagtctgcgacccccatcctaaatacacaagcattggcatcactgcctcacagtaaaacaaaacaaaacaaaacaaacaaacaaaacaacaaagaaaaaaacaaatacaatctgttcagcagagtaattgtacataacacaaaagaacttctgggaaaaacacggaaaggatattgaagtcagaggctcagtcatgtgaaaataaaaggtcttgttgggtgcctaagtcttgtctttgctaacagctgttttcgtgcaataccagtaaacccagccaaaggcattctagtgagcaacacaggaagactcctatacacttcaattttccagcaatccataaaattgaaacataaaaataggattctatttcccttgttcattctatatcttaccagaacttatatttgcatatgtgtagaaactcaaggtttacaaagcatatccacggtctttattgtatttgatgctccacaaaatgttgcaagggactcagacaaagtcttgtttgtactatgttacaggtgagaatgctgacatgtagaggggcaagtacttacctgatcacgttgtcttagtatgatgaagcctcacttaaacccatgatctcatgtcttcccttaaactgatgcactgaaatacagtcaggtaaaataaagagttaggggcacattttaaaatacatttaaggtgcatcaaagatttaaaccaatcacttgtaacatctctatttgtcaaactcattggtgatcattagcatttagagagacccaggaaaatcgcaagattctaaataattttcaaaccatagtagaggatactttgtttactgttatttatgtattaaatatcttttaatatactatagctttataagaacagataatccatttttggaatttgtgttttaattggccaaagagttaaatccattttttctagatcctctggataattaggaatcggtagtaaaaagcaattgcacttttccaataaaataatatgctcagttgttcaaacccacattcttgataaaaacaactagaaattctgcataagatagaagaaaaagaagattttggagcaacaaagagcatacaagatggtaaggaattacaagaccaaaatctaagtgatgtcttgatctcagaaaagaaagctaaatgttgaattccctttggcccttggagaattcatgaaagcagtgaatttgagcttcagtttttcagtctctgtggagtgatatggaagaaggaaaaaatctcaagtccccagcaacacgcatgtgataatagaagactttccccctatgaaacaagacctccaaagagctataatttcacaataagcataaaccaaaagtaaacccacactacctcactcctgcttccatgtgtcggcaaggaagtgttcgttggtgctaaacaaagcatggggaaaatgctgctgttgcataaattacaatctcaaaaactcaagctataaatttagtttaaaacagttcacaatacctaatagaaacaaatgtgcagttcctcctcatcctgaaagaatctccacaataatattccaaggaaaataatgcactcacagcgtatgtatgtatcacctatatgatgtatatagctgatagataagtacatatgtatcatatatatatatacatataaccattacagagaactagaagaaatagtggagaaagaaacagttctacaaagaccctagatttaaaaataatcagagaaaaatgttgtaaaacagctcttctcataacgtccaaagctagaacacacttgaaacaatctcagcaaaagaaagctgtcaaatatgcagccataaaaaaggatgagttcatgtcctttgtagggacatagatgaagctggaaaccatcattctcagcaaactatcgcaaggacagaaaaccaaacacggcatgttcttactcataggtgggtactgaacaatgagaacacttggacacagaaaggggaacatcacacaccaggagctgtcgttgggtagggggaggggggagggataccattaggagatatacctaatgtaaatgacaagttaatgggtgcagcacgacaacatggcacatgtatacatatgtaacaaatctgcacgttgtgcacatgtaccctagaacttaaagtataataataataataataacaataataataaaagaaagctgttaaaaatgaccagcatagaatctctcttccccactgtcagacaacatttcagtggtccctgtaactattgctctggtcctgaataaaatctttctcgccatgcttgaaaaaaaaaaaaaacagaattgcaaaatatgtctctgacaaaggactaatatcaagaatctacaaggacctcaaagaattcaagaagagaaaaagaaacaaccccattaaaaactgggcaaaggacatgaacagacatttttcaaaaaaaaaatgcaagcagccaacaaacacaggaaaaaatgctcagaatcactaatcattaaagaaatgctcattaaaaccacaatgagatatcatcttagtcagaatggctgttattaaaaagttgaaaaaagaaaaaaacagaggttgacttggatgcagagcaaagagagaatgcttatacactattggtgggaatataaattagttcaagctctatggaaaacagtatgaagatatctcaaagaactgaaaacagaactaccctttgacccagaaatattcataactggacacctacccaaaggaaaacaaatcattataggacaataccatgacaatagcaaagtcacggaaccaacctaagtctaacctatgggtccatcaataattgattggataaagaaaatgtgatatatatacacatcatgtaatactacaccaccataaaaaagaatgaaatcatgtcctttgaagcaacatggatggaggtgtagaccattattctaagtgaattaactcagaaacagaaaataaaatactgcatattctcacatacaagtggaagctaaacaattggtacacatgggcataaagatggaaataatagacactgaggtttcccaaaggggagaggatgtgagtgttgaaaaactacctattaggtacaatattcattatttgggtaatgggtgaactagaagcccaatccccaccagtatgcaatatacccatttaacaaacattcacatggaccccttgaatctaaaataaaataaatattttttaaatgactggaatgtgtgaaaaaggaaacaaagaacatttctaaaatagaaagatgcaaaaaataaatttttaaatgcaatggctgttcactattttgtagtagctaaagtaggtactagtgaatccaaagatcagtcagaagaaattatgcagaatgcatcacagcaaaacagaggcagtgagacattttaccatatttttacttggattcctaaacaaagaggagaaagaacatagaacagagaaaacgtttgtaagtaatattttaagataatgactgataccctacatcaaaagaaagccaacgggaagttcctaaatctatagagggtacacaaacataaaactacacttgaacatgtcatggcgagttggacgaaccaaaaacaatagtaaaaccaaagaacaaccacacacatgcataaatccacaaggtagtgaataaaatagcttactttcaaggcagcagaatggcattgaccactaactactcaacagaaatgatgaaagacggatgccagaagaatgagatcaccaaagtgctaataaaaaataattgccaacctagaatttctaggacccactttttaagagtaggatgaaatgcagacattcttgggcaaacaaaaaaagagagtttatctgcagtatatcctcagaaaaggatgtaattaaatcagagaaaaagatgaggatcaagaaggtaggaaacatgcaaaaatcatgacaagtagtttttgccattaagaaaaagatgaaactaattaattccacaaaacaagtcaagaataactcgtgaattagagggagcagaaatggagttgccatcttcaaaggcactcgttttcaggagatgtatacaatttttggaaaaacttgtatttgaaaagttaagtatgcattttgcaattttcagagagtgaaagaatagcaacaaaatacttataaactaggaaaggaaaaatcttgaataagaaaataatctataccaaaaaagccatatttaagtactatgtttattttgttaaattaatttaaattttaaaaaattatcttcactctatgcaataatatttgtgaaattttgactctggtgtgtaaattaacttgtttactgcattgaatcctttgtcatttttgtaatactttgattatctccatctaaatattcaaacatcacctcttaacataaccagtggtacactttccatgatttagatatggtggtctgactagcgttgaaacttgagagaagctagcctcaataacaggacccagggataaccatctagttctccagcgaagggccttaagccttctgggggtccacattgttggttactcactaatcaaagatgtacccggcccctagttttctcctccctgactcaagttcatgtcattcaactctctgcctggttcacggactcatggtattctgccctactcctgctgcttggctatccaccagttaccaaaagctgaagctgatgcaaccacgtgaaatttctacaagaccctcccctctttgggctcccatcacattatcactactgccagatgtcatcagcgtgagagaatcagtggtggtccacaggagcatcttgttgtccctccctaaatgataccagcaccactttcctcccaaaatcaatgctcccaaccacaataccccccttgacttcacttgtgttcccagcaagccatcaaaactagcaccaaggctctctctaggaggctataaatatgtatgttttccttttttctgtctttaaatggtgagttaacacaaacagacctacgtacaccagaccccaaggtatcaatctggatcccttcacaggatccttttccattcacagaaccaagaaaaaaaagcaaactctgaagcccagcccttccctcctctattccggagcaggcagctgatgggacgcaaatggggctgctgagcttcagggtggaaatggaagccagtgccttgtgctccttgtgatgtgaaaagtgttgcagctgcgcagagaaacaagagttttcactggacacagtgcaaggagcaagcaggatgcctttcatggacagaagctgcatctgtctatacttcagccattcaatcaacaaacatttcatgatcatcagttactgctatgaaaggtagatgctgagggtaaaacaaggaacaagatgagaatgccccactcccatatggcacatgtaaaagcataaaagtctatctgaatcatttttgaaacagaaggcccatgacattgcctgctgagtccacattggctcttgtttgtggataccagcacatattaaaattatctgaaatattcagttgtgagccccctcccctgatatggttaggcttcacgtccccacccagatctcatcttgaattgtaatccccataatccccataatccctatttgtcaaaggagagaccaggtggaggtaattgaatcatggggatggtttcccccatgctgttctcatgatagtgagtgagttctcccaagatcggatggttttataaggggcttcttcccctttgcttagcacttctcctttctgccaccttgtgtagaaggtgccttgcttccccttcaccttccaccatgattgtaagtttcctgaggcctccccagccgtgctgaactgtgagtcaattaaacctctttcttttataaattacccagtctcaggcagttctttattacagtatgaaaatggactaatacagtgagaaaaaaaatagctctggagggctgggttacattcaggacatgtactaaatattttaatgcatttttttagcaagcacgtaaaatgtctcccccaaggctttaagctctctttctacttccctaaaggtttccccatcaaaataggaaataaatattgaagctagaaaaggcttgtccccttcaaagtaagtaagggcacgcttcatgacaggcatatctttcttcagacagtgggggaggacacttaattccttcacctaagaaaaaaaaagttacaaaacagcaacctatggaaacaaaaacatggaatcaatgcatcgcctgaaataacttccctgtagtcctgagggtggtgttttgtttggcttgttctccttcccacctttttataccccccaaggatccttctcattctgttgtagccagggctcctagagaaggctgtcaacattgaagggcccagatcccttctaccagtttttcttgtgcttcctatgtgcttgtaactgtgaatctcctgcttttcaaacaactcttctgccttttgtatgggtatacattaaaggggaaaatcagggcctcttcacactactctggcaaaatcaacctgaactgctggattataggtcttggcatctggagctgcctgcttgagccctggcaggtctggaggcttggggctctttcattgactcaggaaatatttctgcttcccacccaggacttctgttgtctcttcctcccttctcctgccctgctctcaggactcttagatgtagcccaggtttgcttccacacagttgacattggcggtgcacggtcttctcccctctacgccctcagatctccacgcctgtgcctatgacacgtgccacctgcaccggtgttgccaagcctggctcctcatccgtggccactcctgcccccacaacctgccagtcctgcctcctttttgcctgcctcctgcctatctttacttcactgatttctttggctggaaaatatttctacaacttcccctcccacactcacctggggctatgacattgttgtgggcactggttgggcctcgcccctaccacctaacaagtacatcctacaggcccaggagggcattatctgtggttttgaatttctagtgtctcgaactgtactggcccagagaggacctcaaatatggaaaactgaagtgattgctttctgcacgcgttacctatgcacccatgcataactcacacaaacttactgaatcttcatttactcttctgtgaaaggggagtaatcaaagaaatgcactttactaacaacaagaggatggcatagtttatcttttaaactgataaagatgttctgaaataagaatctatgttttcaagggtacaggactttggtagttacaccatgacagtaaagatgcatattttaggaacttggtgggggataatttgacaatacacatctacatgtttacattgtacataccctttgactgacactccactgttagaaatttgtactaaggaaataatcagacctacaacataagcacttagctataggaatactggccaaagagttgttgatcatactcaaaaattagaaacaatctaaatatgcaataagaaatatttaaaataaattatattgcattcatctgatgtaatattatacagacatttagaaagctcttgtagtcaaaggataagtaggttacctttggcatattaaatgagtaaaactgatactaagttgatatacccattgtgatataattttctttggttcttaaatatttttatatacctaaggaaaaagattaaaagcttatgaaaccaaaatattcacagtttagttatcacagtctagtgtgattatgggtaatttttattgttttaatttcatatttttctgttcaaagttccatcgcttgtttaattaaaaaaaacttttaaataatattataaaatgaccatcacagaaaaaaatatcattaggcaatattgccatgactatagacctttctccctacactgttattcttacagttggatgctttgaatcgggaagtgatatatcgccttgcttttcactggagaaggaagcgccagcctttgtgagcatgtgtatcacaagctaactagcacgaagattgcatagctctttctacataaggctactgttcgcagaaatttggtccatggtctccagtctcttggggtctcacgctctgtgaaaatcttcgtgtttttccctagcccccagagtcacctttcacacagcgtctgcttgtaaccgcggtccccacaggagtttgtaggatttctgtgccagcggtgaaggtgttctcaccttatagagcaaggtagaaactacgcagacaggcgctgttctttgggatgaaagcagggcctttggggctctttcttagtgtccccgttcggttgtagacataacacgcttgctttgtgtaggagatcggctctgccggcgcccaggggccctaacgcaattcatcgagacccgcaggtcagaactgcagtctcacctgtcttggcggaaatgcgctgcgctcctccctgtactacataagcacgagaattccactacagaagaaaaccccaggcctagtgatggcggttctgggcattttgccagcttctcccagggtgtgttttctgaccccacccacttctgatctgtaatgtcatggtcaatagaaactacttggcccaaacggaaaaggcaaggaggaacacagcgggaaagcctatggcgttccctggtggctaccccggggactgcactcatagatccgcgtgttccgagaagcctctgccatcccgaccccggagccgtgcagaaacccgcggctccaaagaaaaccggctagaacgcacaggaagcccagccagtgttcaggacactgcgagtggaagccgtacgtcccacggactgatctagtttgctgaagacgagccatttacttctaaccccagcagcggacattgccttgctcaaatataaaatatatgaaccaagaccgaaagcaactcttattgcgttactgatgagcaaacgggtttttagaatggttaagaaatgtcccttgttttgggaccgtcatcactaacgtatgcttgggattcctgatcgaggagcttctgagcaaagcagcccaccaatccagtggctgagaacggcttggatattggcttccaggcgcatcagaaatactgaggttctgacaaagacgtgagcttctgtctgcctttgggaaggccttcttccagtcctggcgctgccgcttgccttctgtttgacctgggaccaggtccttcaatttgctaggcttcaagttggaaagtgttacaggaaaataataatacgaagtacttcttagagttattgcacagattacagaagatagtctaatagtacagctagcatcctgtatggcttacattaaggatttgctgataggaaacaacatcccagataaagttttttccccttaattatgaaatataacaaaggaaattgtgtagacttatgcttcaggcctctgtaacatttgaatgaattttgcacttgtgaaggtgacatcattttacaaaatcagttaatactaaagaatgacaagtggaatttacaaaacatatattcacaaaaagaacttgttcttagcagctttgtttacaatagtccccaaactggaaaaggttcatatgcatcaagaggtgaatggacctattgtgatatattcatccaacggagtactaccctcaataagatgggacaaattatggaaacatgagatagcatgggccaatctcaaaaacctcatgctgagtgatgaaaagagtgcattctatgtggtgccatcaagatgaatttctagaacatgtgaaactaacctgtatagtggcagaaaatacatcattaattgctggggtcagggagtcgaggggactgactgcaaagggcacaagaggaccttctggagtagtagacatgtcatcaaacttgaaatggatgcagtgtaccatattcaaccaatgccttaatcaatttgattgtaaaaagtagtaagaaaaccactgcaggctggacgcggtggctcacgcctgtaatcctagcactttgggaggctgaggcaggcggatgggaggcggaggtcgcagtgagacgagatcgagccactgcacttcagcctgggcaacagagccaaaaaaaaaaaaaaaaaaaaaaaaacctccgtctcaaaaaaaataaaaaaaaaaaaacacagcaaatcataatgcattctacttaatttaatgtatgtttagctttagaggattcctttagaaaagcgtctcgctaaatgtgattgagagttcaggaattccttcatttctgtttctgtctctttgtcttcagttaaattcatgcactattaaatggaatatttgtaaaataaaaatagagtctaagttcaattttacaaaagcatatatataatatacagctcccatatatatgtgtgtgtatatatagagagagctttatttattgtttgttttttcttttgcgggggtgcgggggggacagtctagctaaaatatacattcttctctctgtagatataccagaagaacatgactcgatcagtgttgccctaatgttaacaaaagttattttgaacttaaggtgatcagaaattttacctatctgtactttttctgtattggtggtatggtctatgctaagcgtgtataattaaaaaaaaagagagtaacttcaaaatgatttggaagaaaaaatatgtacatatgtgaatagtacttaattccaggtgatgggaatatggatgactggttatcttcttctttctgtatcttttatatttttaaatggaaaaactcaacgacctggaagtgaaagaacagatttggaagaggtgtggggcaggtgagaggaaaatgcagagtgaaactctgtctcaaaaaaaaaaaaaagttacttgtaataaaactcaccaattttaaatctacgatgtaaccatttaaggaggtttgtagaattgtgcagccatcagcagagtcacgttttagaatatttttgtcatttccccaaataccctaaagcctctgcacagtcatttcctaatctctggtgcccatgactgggccccaacaaaataaaaatttggaaatccgacatcattaaatttcaaattttcttagattgggattttttgtagtgaatcattgtcttacttttgtgacatttgaggaaatattgcattttagggacttttttgatgaacttaatagtcctgttcattgctcttcgtgaattgtttcatttttaccgataactgatagttgctaccaaacctggtctggcaagcctaaatgaatgagctaaaaaagaaaaaaatctgctataagaaatagagatagatgatgaatttgcacataagattatgtggagttagtattgtaccatctttattctttcagaaatttggttggtaacattagagatactcctcacatgcttggaatgcctctcattatcttcttcaggttgcaagggctccagaatagtgacataaaggtgaacgtgagtgcaagatttttgctgtagttctttgctctttaatttttttctcttagagggattagcttccatgtatctgaaataataaatcaagagtagagataggcatctgtaccagttttctattgctgcctattaacacatgcaacaaactagtggattgaaaccacagaagtctggaacagaggctgagttctctgataagggttttaggaagctgaatccaggtgtgtctggctatgtagttacgtggagctcaggctacttctccaatttcacttcaggtataggaggaattcattttgtgggagttgaaagactggtttttctttttctgtgctggctgtcccaataacagctcatggagtccttctcaagctcccattcttcctgacgttaccttcttctgacagctagagaaaccactggcatgtatgcagtgatgtgattagatccagtttacacaggtaacctcaccatcttaaagtcgtataactggcttataacaacataatcaccagaatgatgtctcagcaccttaacaggctttagagacaagggtgtggcatgtttggggaccatttcagaaattccatctaccgcagttggacactcacattcccccatctgcaaaatacattcaccctctcccctaaggtttccaaatttcatgtcattaaagcgttagttcaaagtgaaaaatggtatgtagaccacaccagatcaaaaatttaaaatcttatcttaatcatccacaccaagtatgaatgaggcttctgagggtgtccttgacataattcccttccctctatcaacctgtgaaactgaacaaacagcttatctgccctcagtgtgcaatggtgggacagacatagaaaaacgattctttttttttaaaatttttttattatactttaagttttagggtacatgtgcacaatgtgcaggttagctacatatgtatacatgtgccatgctggtgtgctgcacccattaactcatcatttagcattaggtatatctcctaatgctatccctcccccctcctagaaaaacaattctagtgattcttgttcacaaacggggaaagtggaagtaacaaagaagtcactgatccaaaacctttttgaaatggggctgagcaaagtccagcaggaattgcgtggttaggatccacaacctggaactaaccttctgtgacatggggctttgcctctggagtctgcatttctttctatctttatggcaatcattttattttccttcctctcctactcccttggttcttcccctttctccttatggcagcatcctccccttaatccttggcacatcatccccagcagaattggtcaaatgttgcccacgtcacggtcctgaccatctccatgaggggctgtccttgtgaccccctgctcccctgggaccctcttcactgacctgacctctctgtcatgattgctttcagctgacctggctggtttaggagaaaacctagaattgtggagacccagaaccaatctctgccctctcttatctccaagagaggaagaaaataataggtatcaccatggagaaatgacccacatgagggctgagactctccagcagttagagcagaggaaactccctgaagaagggaggagctgagatcccaggctgggagagcaggcttgtgttaagcattacttaatctttaattgctccctgcctgaatctaccagccagcgaatgacaactgactgagtataaatactaggactacagaaccgtgataaaaggtttgtccaaggaaaagcccttttactttatttgttttcacagtggaaattgctgtttttgatccaaagttttctgaaacgcagcagtgagttcctggtgggtgagttaggtgctttggacctggaggctgaggccaaggcttgtgtggtcgatctgctgccaccatgtggtgagggagcctgggagagtcttagtctttcttggcttcactttcctcctcagtgaggtaggggcttattgttcctctctgaggtcgcttcctactgtgttttctctgagtctctgaggaactgagatggtttttatttatttatttttttccttccctttccctccttctttcgtgtgcccagctgccaatcaagccacccacctttccatttgctggggaagggggcggtacccaaccccctctattactagggggttgttatggtaactccccacgcgagggctgggtggcctctagataggacgggctgtccacccacccaattgctatggcaacagtggagccgctgagggaggggccactccgtgagaacttggctggagaaaccacgtgggagttggggggcagaggaggggcaccggctgcctcaggaatgccctttccaccctcacctagcaggttggggaagcatcgaggtgctctcagatctcaggataaggaatcctaccgcagacgtgtatctctgcacctcttttaacgaagtgttctgcacaaaggaactgtttccacaattattcattgatcactggagtcgcgcgtggaggaaggggtggcgaaggggaagagagggaatctgcgttcagtcccttaaaatattgcttgggtcgccttagatctagtcatgttggcatagcgcctacagccattagcctcagtggaggctgggtaatgctatctaagaaccacgagtcatgttctaccgctgaaatgctgtgtgaccttgagcaagttgctttgcttctctgaggttttctttcactgtgaaattgaggggggaggctgtatgatcctcaagagctcttctagcaccaacactgcctctgaaagactccaccaccagccttaatataaacatcatttaagagagtttaatttagaagtccttgaaaaatagctgaacacattcctttctggaccctttttagcatttgggtgcacagccagtcggcccccttccctaacccctagcccattttccttgccactgcccttattccagccgctatccccattcatctcctatttggccttccggcctgactccttcaagtcaattctttttttttttttcttttttcttttttttttttttttttttgagacagagtctcactccatcgcccaggctggagtgcagtggcgcgatcttagctcactgcaagctccgctttccgggttcacgccattctcctgcctcagcctcccgagcagctgggactacaggcgcccgccacctcgcccggctaattttttgtattttttattggagacggggtttcaccatgttagccaggatggtctcgatctcatgacctcgtgatccgcccgcctcggcctcccaaagtgctgggattacaggcgtcagccactgtgcccagcctctatttttttttttaaagaaaaagtctcgctctgtcacccaggctggagtacaatggtatgatctctgctcactgcaacctcaagcttcccggcccaagctatcctccagcctcagcctcccaagtagccaggaccacaggcagtgcatgccaccacgcctggctgattcttatatgttttgtagagatggggctttgccatgtcgcccaatctggtctcaaacctctggccccaagtgatctgcccgcctcggcctcccaaaatggggagattacaggatcccttgaggacaggagttggaggccagcctggccaacatggtggggttttttttttttttttttttttttgagacagttttagtttagtttagttttttgtgaatttgtgaatttgtttttattggggaacaggacacagggtggaaaatgtcaccttggtggagacagagttttgttctcattgcccaggctggagtgcagtggcacaatcccggcccaccgcaacctccacctcccgggttcaagcaactctcctatctcagcctcccgagtagctgggactacaggtgcacgccaccacgcccagccaatcctttgcattttcagttgagatggggtctcaccatgttggccaggctggtctcgaactccccatctcaggcgatccacctgcatcggcctcccaaagtgcagggatcacaggcgtgaaccaccacaaccggccaagcctggcagacatggtgaaactctgctgagatggtttttaatgccacccaggacctgcagctgagacctgactctgtgtgtctcctgcaggagcctgagctgagtccacacactggaagcccagaactgagggaacagatgaaagaaagaaagtcagcaggtttaggggatgagaacaactcacaaaggacaagccattggtaaatgaaaaccaaagaaggggggaataaggacaagttgggatagaagcctcaggggaaatgggcaatgcctgtcatcatccaaactctcaaggagcagcgcgagctgagcagtggggactgagagagaaatttactccacaggagtctcctgcccctggccagggagagccacaggctggatgacatctggtttatagtgaggggcagcagcaactccaagagggggaagatgtgaccatgagccccgccccagacccaggaggcttgaccttggggctgccgtagcagtggatgctcttcaggtcagtgtgggttagagggaataaccatgctgggagaagggttggagacatccattcttatgttaaaaagctctgccctaggtcaggtgctagagtaagtgtcccttgctagtatacaaagcagtgatacttataatattcttctgtacttacagttgaaggaggtttccaaatgatatctcataaatatttattggtgtttaattttctttacgctgtgttaaacacttgggattcagatattaatgtctccccaaaggaactcaagcccatgagagaaagaacagaaatatagctttttaagaaaatatgaaagttcccccacattggggtgctgtggcaacccatagagtgggagtttaagtgaagacattgctcctaatgacagggggaatcataagaggacttcttcagaacagactcattttcctccaatgtcccacagagagggatcctggggcatgaatggtgtaaggcaagggccagtctaaggaaagggatttgctgcatcctgggagaaatctcagcctccctgacaggatatttgggacaggaatgcaggtgagaggaggtttgcaatcgcttttattcaataattgatgaacactctcctgagaactcccttagtgctagaccctgagctgggaaccatgaacacagagattagcaagatatgatctcagctttgacagaactctcagtctagtgaccagcgattcctgagaagtatggtgatggtgggttcactggaaccagtggcccatgctgcatggagatgacctcagtggatggcctggtctctcttctgtttttttcaaatagctgaatgacctatcctgggcccgtgaccctggacttcagccagatcagcatctcaaggtacaaccaacatcttggctccatgatgggtcaaaacagttaacacacccaaggtattcaaggtatcagtagctactgactatgtcctggccagctgtgaaaagaaaggggtgaatttaacaagtattctaaaattgtccttgacatagtaatcacagattatctatcttctgtctggtaatatatatatatatatatatgtttttgtttttgttgttgttgttttgtttttttgtgacggagtttcgctctttttacccaggctggagttcaatggcatgatctcggctcactgcaacctctgcctctgggttcaagtgattctcctgcctcagcctcctgagtagctgggattacaggtgtgtgccaccacgcccggctaatttcctatatttttagtagagacgggttttcaccacgtcggccaggctggtttcgaactcctgacttcaggtgatccacccacctcggcctcccaaagtgctgggattacaggcgtgagccaccactcccagcctctgtctggtaatttaaatgctttggagactccaagattcacccatgtccaaaataaattctatatcagtcatagtactagcatttagaagttgtgtgttttatcctctaattatagatgaaatacctaaggtggaaaggagtaaagcagcttccatgaatgtagtgagaatgtaggggggttagggactaaagtcctgccttaggattccccagcagttgccagtcacaatttttgtactcttagaaacaacaacaacaacaacaaaatgacaacctgttttgttcctctgcttaccctatccaattctctacaccataacatctctgcttatcaagacaacttggattctcaatttgttgagctcaacaaatgcatctcttgagcccctgtgggtaaagcattatgctagttatggcgggtgatacagaggaagcacagaagagtccttagtgacaagagcttaagatttctgctctcagctcagcctgagttgcctgcaggtgagaaaatcagtagccgacacccacaggtgcattctggtgaaagggtcgatgataatgaatagtggttctgacagggctgggctcttaacctcccaaagatgctggtcaaacagaatctggaggatctctgcacatagtgtctgactactgactgtcataagtgaatgtcgccaagtcttggcctggatcccctccctttgtttcatttcacagattacatgttgacagcaggaaaatcaacagaaagaccatgaggctagactccaaaagacttagtaatgctgctgggtgggccatgaatttttaaaaacacatgaagggccttctcagaagtgaagttttaggaaatataaaatgcatagctgggatacattatagtgtactgatagaacaaatattggatatagcagcatctaataacttctggaggaaaaaatatttttcacattactccaattatggccttatatgacaaaaaaagaaaaaaaaatccctaagagaaccactaacatccactggttttgtagaaacaggatacccttagtgcacttaaagttggaaaaatggctctgcctttagggccatgcaatgaaacagactgtgtggtagttgacacaggaagagcagagcagagtttataacaatggccacaagacagttaagaaaatgctttggggcttttaagcagcagataaggtgactcagaggaatgttagacaatcgcagaaaagcaacttcagcaaagtttttgattcagtgggcactgcatacttagtccatgctctgcatctgttctttcacagtctgtcccttcatcgacttgggcctacaatgacttttctgggaggggagagggatcaacacaacagcatgcacacacctgaaataaagaatgaatttctgattttcagattttagtctctgacataaccaaagaagtgactaccatagatgttaactttttttttttattattatactttaagtattagggtacatgtgcacaacgtgcaggtttgttacatatgtatacctgtgccatgttggtgtgctgcacccattaactcatcatttaacattaggtatatttcctaatgctatccctcccccacccccccagatgttaactattaataacataaatgatgctcacaaatatgcagatcttataataacgaggtaaaatagcttaaaaaatagatggtagaactgtagtccagggacactaatagaagtgacccataacattacatcatctccacttccaacaaaaatcaggcaaaagaaggaaggagactggcaacccaatgcacagaactatatataacaggcatactagttattggttggttataaaccagtgggaataaatcttttttatatactgactcttggtttatgtcactgaggcacagcatggaacaatagaaaaccggactgtaagataaatacatttgagtaactggacttttgtaaaccattagacagacatttgagaaaccaaatttaaagctgtttgtgagccatgttagcctatcaaggttgaaattcaggagagatacataacgaaaaataaatgcttttttttttgtgacactgtgatctgatgcattgggaatgtgatcttgtgaatcactcaggtgagcaagcctgacatgagtgggcataaaggtcagtaactgaagaggtaccaaaatgtgctacatgtgtcaattgtgacctaaagaactgaaggcattcaccctcccttgaagtaatgaagctgacacagcagggggctgcaaattccactgcagatcagggtcttgaagctgacatactgaagagtggactcccacttgagatacagagtaggaactactgtttcctacggctactgaatatcccacaaactaacctcctcagcatgccattattaattattttaaagctcttaaaggtctcattttataatagatcacatcagaaggaagactaataaggatcaggtacaaactcatacttgctggacatatcattgcatatcatccccaagtttttggcactacataatgttggaatagattcttgaatattaaattttaaactaagggagaacattggcttctaaattttacaactatagtattgcagctaaacacaagtgcagatgggcagccttataactgcatgagtaatcttaaggaaaacttattggtgaacatacagaacatttcacatgcatttgtctacaaaggacaaactcttcccaacctcagaacttgatatgcgttaggacattcctctcccttgggctggtgataaagctccaattgaaatgagaaagattcttcatgcctggtaaatacgcaagtttccaaagatattgccactggccaatcaaacctgaatccaaaaagcatttgtttctagcaggatataagatcaatatgcaaaaataaattgtgtttatgcaattgcacagcagaatttaaatgtaaaaggaataccatttacaataatgtcaagtgtataaaatccataaatgtgaatatgactgaaaattagagcatatttcacagagaacatagtgcaggcctaataactggaaagatattgtttgctcatgtgtaagaatattgttgagatgttcatttcccctaatttgatctatgaattcaatgcaatccgactcaaaatttcagcatgcatcgttggtagaaaatggcagctgattctaaaattaacatgaactagcataaccaaaatgcctgtataacgaagtgcaaaattggagggctagctccacctgatttaaagaacaatcacagagttgtaatggccacaacagagctttggtatgtgatcaattaaatggatcaaaagaaaatagagtccaaatataaatgaacacatatattgagaacagatttttgacaatcttgaaaaagcaatgtatttaaaaatgcataatatttcaacaaacgattgaagattttctttttaagcaatggatgtgacatatttgtaaccatataaaaataaacaagtagaaaaaactgaattcatgtgtcatatcatatattaaaattagtggttacaagaggctgggaaggagataggggagaaggaagaaaagatattggttaatgcatataaaatatagttaaatagaaggaataagttctagtatttgatagtatattagggagactataactcaaaataacttcttgtatattttaaaataactagaagagaggaattgggatattcctaacataaagaaaagataaagttttgaggtgacagatatactacttacactgattcgatcattataaattgtatatgtttatcaaaatatcatgtgtatccccaaaatgtgtgcaacaattatacatcaattaaaataatgaagagtacatcttagacaaattaacaatgattccaatcccatcgagtaccttttctgaccacaatggtatgaaactaaaaattaactacataaggaaaactggaaaattaaaaaatacatggaaattaaacaacttgcctttgaacaactgattgatcaaagaacaaatcaaaagggaaatttgaaaatatattgaggccaacaaaagtgaaaacaaacataacaaaatctttggaaacagcaaaaacagctcttaagagtcaagtttataaccataaatgcatacattaaaaaagaagaaagacttcaaataaacattacacctcaagaaaccaggaaaaaaacaacaaaataaatccaaagttcactgaaaaaaggaaacaaaaatcaatgcagaagtaaatcaactgaagaacagaaatactacagaaaaataataaaagtgagttgttggttttttgttttgttttgttttgttttgttttccttttcctttctctttctttttctctttttaggagagacaacgtcttactattctttccaggctgattgggaactactggcctccagtggtgatgcaacgtaggcctctcgcacccgagttgtttttctggaaaaagtaaaattaacaaacacttggctaaactaactaagaaaaaaatagagaagactcaaataaataacatgcgaaatgaaagtggaggcattacaacagaagcctcacaagtaaaaaggatcataagaaactattattaggccgggcgcggtggctcctacgcctgcaatcccagcactttgggaggccaaggcgggcggatcacgagttcacgagatcgagaccatcctggctaacacggtgaaaccccgtctctactaaaaatataaaaaaattagccgggcgtggtggcgggtgcctgctacccagctagctacccagtagcgtgtagtcccagctactcgggaggctgaggcaggagaatgacaggaacccgggaggcggagcttgcagtgagccaagatcctgccactgcactccagcctgggcgacagagcgagactccgtctcaaaaaaaaaaaaaaaagaaaaaagaaactgttattaacagctctataccaacaaattggataacctagagtaaatggataaattcttagaaacacacaacctaccaggattgaatcaagaagaaaccgaaagcctgaacgaccaataacaaataaaaggactgaagaacctcccaacaaagagaagctcaggaccaaatggccacacagctcaactcttccaaacattcaaaaaagaaccgggcgcggtggctcacgcttgtaatcccagcacttcgggagtccaaggtgggcagattacctgaggtcaggagttggagaccaccctgatcaacatagtaaaaccctgtttctactaaaaaaatacaaaaattaaccgggggtggcggtgcgtccgtgtaatcccagctacttgggaggctgaggcaggagaatcgccttgcagtgagccgagatggcgccactgcactccagcctgggagacggagcgagagtctgtctcgggggaaaaaaaaaaaaagaaagaaaaaaaagaaaacgaaaaccactgcaaatcataatgcattttgtccactttctgagaatgtgatttcctcttcctgtggaaacagcaataatttttatgagggggtgctgcccggaccccactggaggagtgggtaagatgaggattgtgctcggtgttgcctccctacagaaccacacatactgatctgtaatacctgtggcccctaagtgtccgtgaagggactggtccctttacaacattgcgtatggctgcggaaacccactatgtggcaacaagatgtatatgtgtgggttggtggtaaaaccattataggcaacggaaattcaaaatgtttcagaactcttaaaagttcgcctcatgtagtatttggtttcttgcagggggccccaagcccccggggctgtggtcagctacctgtcctgggcctgttaggcaccaggccgcacagcaggatatgagtggcccgcaagcgagcattccagcctgagccccgcctcctgtcagatcagcggtggcattagattctcatagaagcacaaaccctattgtgaactgcgcatgaacgggatctaggttgcgcgctccttacgagaatctaattaatgcctgatgatctgaggtggaacagtttcattccgaaatgatccttccctcttttcacgtcccccacccctggtccaaggaaaaattgtcttccacgaaaccagtccccgaggcaaaaaagtttggagactgctggtctacagtgtcccaaaacccttttctatggttccttcccaaagcctggaggctctaagtcctcccctgttcttatactcctgtgtgttgagaaaaatagcatttcctatgctctgaaggttctccagaacattctttctaggctgcaggatggagattaataataacagaatatttggcatggccttgttagccaatccaaagccctctgggctgaagtgggggtttttcacttcagggtcatccagcctgggtaccttccatctcagcatccccaggcacagacaggaaggtgacatcaccccatttacatgatgtctgtctttgtggcctgggccactgggtggcttacctcagaggcggagatgtcagagatgggtgttctgggcatgattaacaaagggaaaactgagagcgttcctactgaagccccttctcctttcagctcccacccaggtggcctgtcctcacgggccttggagtggagacttgagccaccaactgtcagaggtggagacttcacaggcacagctggagccaagaaccctggtgcccaattgtctgtgactgcaactggatcaagggtttgactgtggctatggcttagccaggcaggatgtttcctccaccacctgcagcttcacaaccaacggtgatcctgggaaccaatggcccttccaaggtagggaaggaaaggggaccaggaagctctcatccgggtgtcctggtcatggtgctgtgaggggaggaggcaatggggtctcttcgtgctccctcagagtcaagcagaaatccacaatgttccaacccagtgaggtgagcaagagcctggggtttaggatcaaatctgctctcaggtcctgggcttaacccttactcattattcatctcggccaagttatttgtggtgttggcatttacatctcagtcctgtcatctgagagacctgaaaaataatatctacattccatcattgttgataacattaattatgataatttccaaagggctaattcagtaaaaattgcttaataaatctatgaatagatgttatctaattctgttatctttctggtaagttagcactcaggaaatgacttcacgtgcattgtttcaactgaggaagagtaactgttaggatctctactttctagagactcccttcctgtgtttacttagaaagtatcttttgccagttttctttctcttcctcagcatccctttttaagtcaatttcccccggtcatgcacttcagtaacaacctattaggcacattagtaaaagtgcaaatcctgggcccacaagtcagtctcctgacatacccagcttcttgctctgttttctcccctcgttttgaaataaaagaatgaaagggcaaccttctcatggaaagggtataaatctgtctcttttatgaaactccatttagttcatcatctccattcatgcccacggccatgtcctcagttttcttctcacagggatccacttctgcccagatttccttaaaaccctgggttgtgttcatccttactctccgtcccactcaatatctactcctggagcccctggggctgcctggtgctcatctgtcaatcgatgcccccagccgaggaataaggagacccacgtcctcaggaggagggagggtcacgtgagataacgagcaccatctgggtccatggagaggacacatggaaaacgctcagtgagtgtcgggggatgcgtagtccctgacacgtgccctgataactttgagtatttaaactgatttcttcccactggtgtctcttttgcttctccatggattcctgcacccctagtcaggactcaccccgctggctccaacactcttacctgctggctttcccaggagtccggatcactaaccaggttccaggcaagaggacagagtgaatgccttttgtttcattgtcctttacctggtgacttctccttgctgtctaatagggcatttgtttctcaccatgtcttctctctctcgttcatcttatttttctaaaattttttccagtttcagtggaccagattataatgttagtgattataacgctaattcaacatcttccacatccttatgtaacaatttcttccaatagatttatatatataaatatatgcatttatgtcattggatatatatattatgcatatttggcatgtatttttaataaaatgtagatatatgctacatacatatctgcatgctcatttcatcaatatctcatgtttagtctatccaattcttttctctcatatgttcatttaatgttgagttttagaatctcctccctcccaaaacacagcctgtatccagtctgacttccttgcctttgccttatctacctggaaactatttgtgtttattaatcctaaattttttgaatatgtttgtcagttgggatcaccttttcctcctggcaatcttgtcattactgggtgatgcatgaaaaatcaacaatacagaaaataccaaaatgtctttcctggcttccctttacccgttggactttctcattcaagaccactttccttctctgatgatcctcttgggtggaagagaaagtcacagtaagatcatggatgacagtgaacactgttgggtgtggtttcattttcagagctgggtttagagccttcccttgaatgaagaaccctccccagctggaaggtgatgctattgaaggctcagctgacaacatacatgggcatcaagtcattggccacattcatgcctcaagtgtcctaaaaccgaagatgatcaaaagaaaactgctgttcagcaagtggagactggcatgcagattccctggcctgcaagcttagagcaggaagataatcacatctatggctcttagctgcactcactccttattcctctctgtctatgatgacagctccttctcccactgcttttttcttctgtatttgttctctccagcagctgctgtcacctctgtctggtattacctctgtgtcccatgggctgccatgctgccaggtccttctgatccccatcccctgaactctgctctctgaactctgctctgttcccactgctgttgtcctaagagtccctctcatggccgcaggagagcccaacttccttgtccccctccaagtgcatggtgtgagctgctaaacacagggttctttgcctggaattgcacggcttgagtaatttgcctttcctttctgcatcccaaactccattgcccctttctgccaggagcattgctttaatacgtcatttacacacagatttttctcttgggacagcttttgagcaacacaactaagtcaaactgtaaccctcaccttgtacatgggaatgagaagtgttaaaactgagcactaagaactccaaatcaaaaactaaattagaacctgggtcacagacgagagttccctactagcctggagtcaggtgtgtcttcatctctagatgggcaaccttatgccagcgtggatgaagtttccagggactgtgtctgctcttcatggagtcacttagctgacattaactggagaacatttatgacattccaaagggacctcagccaaagatagatgcagagggcagggcaggactttgaacctgcgtagaccacaaagtgcattctcacctctgtcctttttattcacgtatttacttctacaagctcagttagagtctaaaacacaactcaggtgaatcttgaggacagagaaataagagagcatttaatgaattaactttgagaaaagtgagttcaggggccagctttatgtctacacaagatgatagacaagaacctatctacaggacagactttgcctcagaccagcccaagtgagagatttaattgaaatagtcagaagaaagactaaaatccacagagccacagagaatgaaggcaatcacgagagaaatgaggggataggaaagaaaatgatgagaaatcaggttggttcattcattgtctctaaatcctgctaccatgtaataagcacctggtgagatttcaataaagatgaatgccttgaactgacatcttgagattctcacttaaatggtctggggtgtgatgtgagcatcagtacctttaaaaaacttccatgatattctaatatacaactgaagatgacaaggaccactggtctactctgacctcaggttttcaacatggagatgaccacttgtgtggctactccacacaaaaggcggaatatccatcagacattgatgggatctgtattcacctctcaacagtagtatttgtagaacgtagaaaaaaattaaaaagaaaaacaagaaaatagatggattagacctgtagtctctctacttaaagcacacttgcttaattttgagtacaagtaaaataagaaatagtcattgtattgaaacccagtatacagaaaacaatacctcgtatattactcatattcagatttagtattttcttttaaattttattttattttattttattttatttttaagacagagtctctctctgtcacccaggctggaatgcagtggcgcagtctcggctcactgcaacttctgtcttgcggcttcaacaattctcatgcctcagccttctgggtagctgggattacaggtgcctgccaccacacttggctaagttttgtattttctagtagaggcatggtttcaccatgttggcaaggctggtctcgaacttctggcctcaagtgatccatccacctctgcctcccaaagagctggtatttaggcatgagccatcatgcccagccttcttttcaattttaaaataaatcctgcagtttacatttccacacactgattccacagcccatgaatgggttcggcactgcaatgtaaaaattctgctttgctcaattcttgtcattcagccaagtcctcagagagaactcgtaggtctcactccactagacagaatataataataagtaaaaactgaaacttggccgggcatggtggctcatgcttctaattccaacactttgggaggctgaggagggtggatcacctgaggtcaggagttcgagaccagcctgaccaacatggcaaaaccctgtctctactaaaaatacaaaaattagccacgcatgatggcacatgcctataatcccagctactcgggaggctgaggcaggagaatcacttgaacccggaagacggaggttgcagtgagctgagatcacaccactacactccagcctgggtgacagagtgagactccatctcaaaaaaaaaataaataaataagaaataataataataaaaaaactgaaactcaggaagagatgatatatgaatacttttttatgctacccttgatgctggcaagaaattctaaaaagaaatctttcccaacaaaccactctgggaaaaatgtaacagggagaggagaatgtaataaaacacaaactaatccttttcactttctacttcagagttttgttgatcagatattgagcatgtttctagaaatgccttaaggtgtaaccaggtgtggaatcaacttcagggaattagggataataagttgggccatggttacaatcaccacccttcctttgtaattccatttgactctttccttttcttctgatcctttttggaagaacacataatatttcttttgtctttttctcattttttattttaaccaacaaaacaagcagcagtgacatcatatttctttgtaaaagctcattcctatcctagccaaggtgacccagcaacctctagtgactgtcgagaactccagattggagaattgactctcccttctctctaacttattgaaagagacttcgtgcgtgggttctagtttcagggttgtccattgcaagtcatgtggctttagttaagtcagccctgtggcatcactgctcctctgttgtaaaaggcagaactggatgtggatgcggtctgaggtccttcctgtatctcacctccagggttcttcccatggccctgcgcacccttccctaagagacggggacatggagttgtaagggagtgggtttctctgcaaaaggtcctttccttctgcagccctctgtttctgagctttcatggttgatgctgagaacatcctcactgaggggtgtgaaaagccattactctgctccagacactggggatcaggaggaaaggggctgctggttgggcagagctagggtccctatatccttcacctcaagctgactggaagttcaggggtgtttatttttcacttgcggatggcacttgcctcttcactcagcctgaggctcacccttcagctcatcctcctagcaggagctcagtttgcccctgggctatcaccacttaacagtccctctagactcagccatcagcaggacctgacaaagatgcccatttgatctttccttctctctctcctacagatactaaatgctgctggaacaatgaaaagaaagaacggatgtcacaaaagcattttcatttgatgaatagaactaaaagagcaaagcaattgaaagctcaacacaacacaggagggatccatggctgaggattgtatttcagaaccactgactgctcttgacaattgttaacccactaggctcctttggttagagaagccacagtccttcagcctccacttgataccaatacttaggaagaccaaagccagatggacaaacagcattgagaggctttagccctactcctctcagcttccatcctgtagagaacaggagtcaggagctgctggcaggagacagcatgtcacttgggactctgccagtgcagaatatgaacaatgccatgttcttgctaaaaatgcttagcttgagtttcataggaggtaatcaccagatagacaactgcagaatgcagaatactgagcaggacaataacctgtctccttcagacagtccatgtcaccacgaatcacacaataaaaaggagaaaagacattttgggttcaaaaaaactaaaaagataatgtagctatatttctttagttattttgaacccaaagtatctcctcatctttttgttgttgtcattgatggtagggacatggacttgtttgtagaggacaggtcagctgtctggctcaatgtcctacaagagacaggggggacatggaagcgtacagctatatttgtggattagtctagctatctgttcagtatttaaagttgttgttgcatagatatttatgacttttgtcaggggagggtttggtggattggtcctttcatcattttataacgtccctttctctctctgattagtttctttgttctgaaatatactatatctggcattaatatagccagtcttcctttcctttagctaatgtttgcatgatatatctttttccatccttttgatttcaacttgcctgtatcatcatatttgaaggtagtctctttgtagccaggatgtagttgggtcatgtccattaacctactctgccaatctctgtcttgtaattggtgtacttagcccattgatatttaatgtgatgattgatatggtagggcttaagtctgccattttatttttccttttctgtttgttctctctggtttcattttctggatatgctttatttttcttacctgctgtggtgacttgaacatctttgagaatggtgttttgccttatccatagtattttttagtatatgcgtttgtatagccctcttggtttttccaggtatatatatatatatatttatatgtctgtgcatctatatctgaccacatggtatactggtgtcattgtttcaccagttgagtgaacgatagacgagcaaccttctatataggtctctttacccttccagtttataattgtttccaacattttctgtatgtagagttagaaccacatcgaatggttctatgattttttttctgaaaccgtcaagcatagtttagaaaacacaagaggagaaagaaggcctattttgctcactgttttttaaaattttctttctgacatcccaagtttccttctttaatcatttcctttctgtctggagaactccctttagcctttcttttaaggcagaactgctggtcaaagattcccttagcttttcttaatctggaactgttttgatcttccccttaattcctgaaagatgtttctgttggacagaggagtctgggctgacaattattttctttcatggcttgaaaagcactgcacaacttctttctgcctccatggtttctgatgagaaatccatcatcaccggaattgtttttcctttctaggtaaggtgtcacctttctctgttgttttccggatattttccttgtctttcttttccaacattttattttgtcacgtgtcttgccatagacctctttgggttttatcctatttagggttctcacagcttattgagcctgtaggtttatgtcttttgccaactctgggaagctttcggccatttacttctttgagtatgttttcagccttgtcttcttcctcttccccttccagacactgataacaacatgaaagtgagaacttttgaggtagtttcacaggtccctgaggttctgttcactttcccccccagtctattttctccctgttaggattctgtaatttctgtttttctcatctgcagtatatgaatttgtttgctccacaccatccattctgctgctgagcctatctgctggactttttattttagttgcatttttcacttctaatacttccatttggttcttatttatgtcttgtatttatttgctgagtctttctacttgtccatttgtttcaagtgttcttataagtactcattaaatcatttcattaggcttgcctgctttaaactctttgtcagacaatcccaacacctctctcatctcattgccagcgtgtatttgctgtctattttcattcagtatgagattttcctagttcttggtatgatgaatgattttcaattgaaacttggacttttgggtgttatgttatcagagtttcgattttattgaaaccttctgttttaactacctttttttgagtctgtttctgcaggggaagaagagtggtgccatctcattgtagccaggtgtgtgtaaaaatccaggtttctcatctgactgacctctgttgacaccctgagtggaggagctgctaaggtaggagagggagttccagcagcccactcctcctccactgctacatccctggctgggtgggtaggagtgcttcattactgctttccacgtggcctccagtgacaccacaggacaagggcagccttattactgctgggtggatgaaagtcctgactctccaccaggactcctctgataccagcctagcagacagagggagaggtgcctcatgaccatctaatgaagtctaggctccaaatgtagtttctattgacagggaggtaaacatattatcacctggcagggatgatgatgacagccccagcttcctcctctaacatctgtcattgaaattgtttttcccctctaggtaagatgtcgtctttctctgttgcttttgaggtattttctctgtctttagtttccagcattttagtcattgtgtgtctcatgataaataaaatgctggaacctaaagaacccccggggcaaggtgggggtttagcatatgtcattatacctgcgcaagtgtgaaacccgaagcccctcactgggattttgctagcttttatgttgatgcagccacagcttttcttccacggtgcttgacctgaggaaactgatgatcgtatatgtgtcttgtcttgctagactgcccctttgctgatcctttgcctagagagagcaagattgtattggggtttgctggatctgtagccattggtatttctgggttgccatctcctttggctctacatctaggatgtatgcgggggcatggaggaatcctgggaactcatctcctggctttctgtgggtcttgaggaagccagatggcctcctaccttctctttgcccttcagtcttcctatgtttgttgtatgtacaatgcccaaggtttttagatgtaatgagcaggaagaatagggcaaagttcatctattccaccttcccagtgtatgcctgtgatttccctgtcttgccttattgatttgggtaggattgtcatgtgaaatatcagtggtgagcgtggtcttccttgcttagttcccagtcctagagggaaagcatgtggtctttcaccatgaggtaagaagttaactgtgaatttttttgtaagttgtctttatcgagctgacaaagtcctgtgttcctatgtttctgatagttgtaaaacattctctttcttcccttctttctattttttcttatttctgttgtttgttttgtttttttgagatggagcctcgctttgtcacccaggttggagtgcagtggcgtgatttcggttcactgcaaattccacctcccaggtccaagcaattctctgcttcagcctcctcgtagctgggattaacaggcacctgccaccatgcccagctaatttttgtatttttagtagagatggggttttgccatgttgactaggctggtctcgaactgttgacctcaggtgatccacccaccttggcctcccaaagttctgggattacaggcatgagccaaagagcctggcctcccttctttatttctatcatgaatagatgttgaatttgtcaaatgatttttcttcattgactgataaacatttttgtggtctggttttggagttggggtaatcatagctttacagaaatagtcgagaggtgttccttcatcttctattttctggaacagattgtacagaattgatgttaattcggctgggcgcggtggctcacgcctgtaatcccaacactttgggaggccaaggcgggcggatcacgaagtcaggggatcgagaccatcctgactaacacggtgaaaacccgtctctaccaaaaatacaaaaaatcagccaggcgtggtggtgggcacctgtagtcccagttactcgggaggctgaggcaggggaatggcatgaacccggagggcggagcttgcagtgagccaaggttgcaccactgcactccagcctgggagacagagcaagactctgcctcaaaaaaaaaaaaaaaaaagaattgatgttaatttttcttcaaccgtttggtagaattctccagtgaaaccatctggacctggagcttttctttctggaaattttaaaattaggaatccaattattttcatagttacagagctactcagatgacctgttttgctttaggtaagttgtggtagttgatacttatgacaaatttgtccaattcatctgggttgtcaaatatatgtgtgtacagaattttaaatagtttttcccttattattatccctttgatatctgcagtctgtaatgagtgtagtccctctttcatcctgatgttcataagctgacttctttttttctttgtcaagtttattgatcttttcaaagagacagctttattttcactagtttccccttttgtttttttctgttttcaatgccattgatttccgctattatctgtattatttccttccatttgctttaggttttttttttttgtagattcagtctcattcccatggcgcaggccggagtgcagtggtgcgatctcagctcactgcaacctccacctcccgggttcaagcgattctccttcctcagcctccagaatagctgggattacaggcgggtgctaccatgcccagctgatttttttgtatttttagtagagacggggttttgccttgttggccaggctcgtttcaaactcctcacctcaggtgatccacccaccttggcctcccaaagtgctcgtattaccggcgtgagccaccgtgcctggcctgctttaggtttcttttacttgcttttttcttgtttcttgaggggggagcttaagtgtattcatttgagacatcccctcttttcttttatcccttttaaaaacttttgtatataattattattgtaggaagttaggcttgggcccgcaaactatggaagaacagaatatactaggccgctgctttaatagctggtgcctgcttgtcgcccacccccactcccccaccttagctgccttgtccaaaccaaagagtttagtctagaatggacatttactagcctgcaaaatagttcactacatctattcttatcagcttgcctgactgcccaggtcataagtcaaatacttgaaaagcccccgagctgaccatgattgcaatgcattatggactgcaacaaaatacagggagacaaccctaaaaaaaaaaaaaaaacaacctaaaagtccaaacccaagatccaataggcgacatccgggaatactgtgaccccatagtactcagcctatgaggaaccgggggaggcacttccacactaggggataaattgcttgttgtaagcctactgggtgtgcctgcctaccagacacccgatcttgcaagactgtcattaataataagtcgcacttctgctgttttccgggtcttggagtccattctttgggtttggacaggtgagtttatttctcacgattatttccaggcaggccttgcccagtgggtggctcatgcttgtaatcccagcactttgagagggtaagcctggtggatcacctgaggtcacgagttcgagaccagcctggctaacatggtgaagccccgtctctactaaaaatacaaaaattagccgagcgtggtggcgagggcctgtggtcccagctactcaggaggctgagacaggagaatcacttgaacccaagaggcggaggttgcagtgagccgagattgcatcactgcatgcgacagtgcaagactccgtttcaaataataataataataataacaataataataatggcacgacctaaagttatgcaagcatttgccttagataaaatttcaagttttcaaagttgttagctgggtgggcggcatggctttacttcctatttcttggtatgtcctaatcttgttgaaaaagtttttctttttctcaaaggcttatttcagtggaagcccatctgcaaaatctgttattaatttaaattagaaaatcactacaagtcccactgacatgtgggttattgtttttgcgagtgacctaaggccacctctcgggggagctgggggttgccttcccacgtctgcgcgtctgcaccccatgcccgggcctggaagtcagactcgggggcggtgctgcagcaccaggcctgcagtcctaagcgcggggtcgctccgggcccccgagggggtgtgtcttctgcccctttaacctggcaggggcggttcaagtggccctggaaatcagcgatttgtagggtcaagggctggtgctttaaaagagaggcggaggggagagagggatttcccggtctctgctgcactctgtctatccgctcggttactccttttcctggcccgcgcgaacccgctgtgccgcagaggcggccatgtacctttaaggccccgctgcgcctgcgccttgggctctcctgacgcgccgggcgggaccctgaggagccagctggcgcaggctatgggctgggcggcggttgagacagcggcggtatcgggaggggtaggtgagggtcgcgaggctgcgtgagcatctgagtgaacgcggtgcttttgggaacgcgggacgggcgacctgtggcgccaggagcgggccgaggcgtggcgcacggatgccgtctggatgggaagttacggtttacagcgaagtccacccagcgtttccgaggtgaaggcgccgcgccaggccgggcgggcggtgagtccgggacccgcgggtacacagctgggtcgagctgcggctgtcgcaagttttgttgcgagcgacggagggcgaggcggggtggggggttgggagggcgtgtgttccggccccgccggggcttaagttccatgcgttggattcctcgcttgccgctgccgcccgcagccctccttgggcgctggggaagaaactcgctggcgggtgttctgtggcatctcagggggtggagggacgagcagcttcgggggcacgtcctcgtgtatcctgtggaggaccctgaccccgcaccccaccctcgaggccagaaatcggttgcctctggggacctgagaagcgagaccactcgcgcccctgacttgcaaagttggggtctttattggcctccgggattctgctcctggcggtttctccaggctggtgatgggcaagccgggtgtaccaagtccaggatgcacatgaggagcgtttgtagcagtcactgaatcacctcatgactagcggggcaggcctctaattcaccgcaggatttccggtaggttggattgtggggttggtgtttgcactccaaagagttgctgtgatttccctgtatctgtctttctggcttgttagatcttctcatttggcgtcctttctccgaagagttaaccaagacgtttggcatggtttccttgctttcctcctatcttttgctgctagagctgctttcgaaaagaagtcttttcttgcagtggtatcttttctttgggttacagtgttgttcatcctttctttgccgaaagaatgaatcccagtgcttcacaaggttaaaggaaagatctgctggtagtgtttagtctttgttctgagctgatatgtgttagtagctttttgtttttaaattttattagtaaaatttcaccagtgaaccagaagctctttttttctgttgtgaaatgctagctttaagatttctgagaactttgtgtcaaagaaatctttgaaaagttactgaagtatacagagaggttcacaattttaaatgtgcaggtggtccgggcgcggtagatcacacctgtaatcccagcactttgggacgccaaggtgggcggatcacttgagcccaggatttccagaccagcctgggcaacgtgccaaaaccctatctctactaaaattacaaaagttagctgtgtgtggtggtgtgtgcctgtagtcccagctacctggtaggctgaggtgggaggatcaccagagcccaggaggttgagattgcagtgagccgtgatcatggcagtgcactcccgcctgggtggcagagtgagaccctgtctccaaaaaaaaaaaaaaaaaaaaaaaaaaaaaaaagtacaggtaatgaatttttaccaagtgaaccaccacagatcaagaaatagaacattactagactggggtatatttgtaggagtggcattgttggttttagaggtatatgaatgataaaacttagtattacatattgttgaacgttttcccaaagtggttgtaccatttagcagggatactctggttaccccacatccttgctgatgcctgtcagttaaaaattattttgccattctagtaggggtgcagtaatgtatcagtgtgatttcattttgcattttcctggtattgagattgagtatcttttattgtcatttgtgtgtcctcttttgtgaagtgcctgttaaatctttttatccagttttcattgatatgcttgtttttctgttgatttgtaatacttttttctggttatgtgtcctttctacgatatatatgtattgcatttcccttttttcaatctgtagcttgccttttcgctcttttaatggtgcttattcatgaatggagattctctaactttttttttctttttgagacaagatctcactctgttgcccaggctggagtgcagtggcacaatcacagctgaccgcaaccttgacctcccaaggctcaggtgatcctcctgcctcagcccccaagtagctgggacctacaggtgagcaccaccacactcagctcttttctgtatttttagtagagatggggttttgccacattgcataggctggtctggaattcctggtctcaggtgagacatctgcctcggcctcccaaagtgttgggattacaggcatgagccactgcacccagcctgagattcttaattttaatgaaattatactttatcaatcttttcctttatggttagtgctttttgtgtcctgtttaagaaatcaatgccgaacctaggagtatgaacacatttttctgtgttaaccttatagcaattttattttagtttttgcatttctttttttttttcagacagggcctcactctattgcccaggctagagtgccgtggcaggatctcagctcactgcaacctccacctcctggctcaagcgatcctcccacctcagcctcctgagtagctgcgactataggagtgtgccaccatgcctggcttaattttcatattttttgtagagattgggattcaacatgtttcccaggttggtctcaaactcttgggctcaagtaatcttcccacttcaacctcccagagtgtggggattacaggcatgagccaccccacccggctatgattcactttttactacatggatgtgtctgcttgatccagcaccatttattgaaaagactatccttttccttctgcactgtttggcactttttttcttaaatcggatgactgcatggtcatccaatttatgaaattagtgtgggtctgtttctgtttctggaccaacctgggcaatatagtgagatcccatctctacaaaaaataaaaataataaataaatgagtaaaatttaaaaaataagtgcatagagcagatggagtcataggtgataatttataaatgattgtcagtttcttggctacatacgggtgttggtaattcagatgtgttgggcattcagggaaaatgtattaagggaagtatgtggtgttcacagtgattgctagatgttcattgtgacttgaattagatgttatttgagcctcacagagctacagtcttgactctttatttatttatcttttttacaatttttacaatcttcctgtcaaggcagtaactcttttatacttcattgttcttaggtatacttaattaccaggaaaactttatggatcgtacctaaataagcgttaagccatttaaagggccgacgtgatgtgatgtaaacaatagtattctacataatagttttaggactacatcgaacaattttttttttttttcttgagacagtgtctcgctctgttgcccaggctggagtggagtggtatgatcatgggtctctgcagccttgacctctcaggctcaagcagtctgcccacctcagcttccttagtagctgggtctacaggcatgcaccactatgcccggctaattttctattttttgtagacagggttttcctgtagtgctcagactggtttcaaactcctgggctcaaatgatcctcccaccttggcatctcaaagtgttgggattacaggcataagccatcaccgctggccattttagttttaataatttttatgtttttctaatttaaaagatttactaaaatctcttacagctattatttatgagtatagtattcattgttgttattatgattattttgtatgtgttcaatctcattttcaacataagctcctggaaatttgagattttgtctcttattcaccactgtattctcagtacttgaccttgcctggcatgaaacagatattgaataaatatttgttaaaggaatgaatgaaggaacatactaataccatattcaacaatctccaagtgtcacagttttcaccatctaacaaataaaatagcttgtatacagcagagtcacagtcaacctgacataaaaggaaatgtcaatgaaaaataaacctttgtatgtgttgctgctaagattttggggcttttgttactgtagcataacctagcgaaagctcagcgagacagcctgtagaatatacgtgtacagatagaccagatagaccagtagatgagattccaaagaagcattaactacacccacacactcataattccctaacagaaagaatcgaattcttgttcactaagatctgcctcaagtattactttgtgaaaacttccctggctactcaagtatttagtcaggactctttatttttttttcccccaggctggagttcagtggtgccatcatagctcactaacctctaattcaaggctcaaggaatcctcctgcctcagccttctgagtagctgagactacaagtgtgtgccaccatgctgggccaatttttcattttttattttcagagatggggtcttactatgttgccgaggctggtgaggactgttgattacatatgacaggaacccaaacaattctagttccccaccacctttcaacctgctcctccctgggtcttcccagtctccgtaaacggcagctccatccttcaagttgccgaagccccaaatctcaatattaaccatgatttctctcttttatctcataggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctggggctgccaccaactcccactgtccagggcttccagtggactctccgaggtactgatgtagaaacttccccattcggtgcaccaagagcaacctcacacggtgtgggctgaatgaagagctgccagatcccacaggtaaaaaccctgaggcattgccagctcgatggagtcagagagtcctttttctattatgactcagatgtgaagggaagatgccaagggccctaaacatcgcagggccttgcctggcatgaaacagatactgaattaatatttgttaggtgaatgaacaaatattcacagcgtgtgccaccctcgacctgcagtgccgtcgtcaggtggaagtgattttacctcaggagaggagagtgttctctccaggacttttccttagtagctagatctgcatcccactccttgctcttcccctcttaccccccattctctgcccccatttccgtctcttgtttccaccctgccgtcccctttcacctgctttctcctcttcagctttcatggctcaccccctccctgtccacccgcatcccccaggctaaggccctgcactgtcctgggtggggagatgtgtgtggttttaggcagtgccctctagatgtgtccaggatggggaaacatggctcagttgccagtataatgtgttaaaagagaggccacttttgaaggccgttcccatctcccattccagaatcctgtaggacttagaatttatgggccacagtggaattcttggttccccaggaccttgtggtggatgccttctttcactgagcattcatggggtgactattaggtaccatgccctgctctgggctagagaccccataacgagtaaatctcaggtcactaccccatggaacccaccactgcaggcattgagagggggagaaagaaaggggcatggcctgtttgtatccttctcacgtggccgtccaccaggtcctgggggagtgggagccagtgcaaggagggaagtccagtgagaatgacaaatggacgatgtcagacccaggggctgaggcccccacctgcagctgggaagcttctggagtggacaaggagcagcagggaaggttgcggcctggtgttctgggatccactgtctcatctcattcttttgggcaccagaacttatccaaagacaagactcagtgtctctggcaacagtgggccagaggaataatgtgtttcagaggaggaagaaggggttgtaccccgtggaaacagcatatagttttacagtagtgcatctgtctccaataactagttagcgtgttcctgttaatgggaaatactggtggtgtaagttcccctggatgttctcatcttcatgtaaatttgttcatttccttccttccttccttccttccctacttctctcccttccctacttctctcccactctttttctctctctctttattctttccctccctccttcccttctgccttccctcccttcctttcttcctcccttcctctctccctccctgccttcctccctccctccttttcttcctccctcccttcctccctcccttccttccttccttccttccttcctccttccttccctccctccattctttcctttcttcctttcttcttttctttttctttgtctctcatgctctctctttttctttcctttttgttctactttttaaaaaagaccacactgcactgaaatctacattacttaccaaaacctctggagctgcttctgtcttgtaggcagggagctcgtcctgtagcccttaggtcctcccagcctcctcctcctctgatttgtgggtgccactggggcagctgctgagtctcagtggttcctagtcatcaccaagttctgcccacctagatggtttgcacctgtccttaccagaaccctgcactgtctagatgactgaggctgcttctgcctaactgatctgctagctgtgttccgggggcaccccagggttagaggtaaatggcacaggcattgaaatctccaactgctctgactccaggttggtgcacttcaatgccaagtactaaccacacaataacaggatgccaccaaaaccttggtatggggctgctgcatcctaattaaaaaaaagtaatagatgttattttttagaacagttctaggtttacagaaaaatggagtggatagtacagagagttctcctaggctcccctgtcctccagcacacagtttcccctattagtatgttgtattagtgtggtccattcgttacaattgatgaaccactattgatacatcattatcaactaaagtccatagtttacactagagttcattctttgagtttcacagattatgggttttggcaattatgtaatgtcctaaatccccaatacagcatcatgcaaaatagtttcactgctgaaaattccctgtacttcaccatttcgtgcctcctcctctcctccacccctgacaaccactcatcgttttactacttctatctttttgactttccaagaatgtcctagagttggaattacagtatgtaggtttccagactggcttctttctagcattatgtactttaagttcctccacgtcttttcatgacttgacagcttgttttgtaaaatcactgaatcagatttcattgtatggctacaacacagtttgtttattcattcacttggtgaaagacgtcttgggtacttccaagttttgacaattatgataaaattgctgcaagtacttatgtgcaggattttgaatgaacttaagttgtccaaagtgactgtacacttttgatttccactagctatggagagttctggttgttcctcatctttgacagcatttggtgtgttcaccgttttgtgttttagccattctgataggtttacagtgatatctcgttgttttaatgtgcaattccctcacaacaaatgattttgagcatctttctcatatgcttatttgccatctgtatatcttattaatgaggtgttcagatgtttcacctttttttttttttttttttttttgctttgtgttgtttagttctcagaattcttcatatattttggacagcagtttttccatcagattattttgtaaatattttctaccagtctgtgacttgctttttccattctcttaacagtgtctttcacagaacagaagtttttaattttaatgaggctcaacttaatttttttttcattagtagattgtgcttttggttttgtatctaagaagccatcattgaacccaggatccctcagattttctcctatgttatctcctaggattcttatggttttgcaccttacatttacgtgtaagatttattttataaagggtataacatgcatacctggatttatttatttttttgcatgtggttgtccagctgttctagcaccactagttggaaaggctatctttgctgttttaaattgtctctaaacctccatggaagatcagtggactgtatgtaggcctgcttctgggctccgtattcttttccatgcatctatatgtgtgtgttttctcttttcaccaacttcacactatttgggttactgtagcttaatgtaagtcctgaagttggtagtgccaaacctcagggagtttttctgaacttcatcatgagaacctggttgagatcattgtagtaacacttggaaatgtgtgagattcccccttagtctggtcttcaaggagtttttaatgttctagccaggctaccctcagcttctagtaatctgtcagtaccatttaagtgctcctcccacttgctgtccccagtagcttctcttccctgtgagctgtgactccttgtgtgttagcctgtgtttctcatttttaaggtggcagttttccctgtgacctcaattctctgatccaccctagaagggttgactttcagtttgttcagcttttttctagctgtgaggacaagtgatgactgcctagctctttccatgttgaaatagaaacccaaaagtttgtttaaagaattacttgttataaaagtcccccattgttaatgtacaactcaatgatgtaagttgatttatcgaattgtgcagccatcagcagagttctacttcagcatattttgtcacttcccaaattcccttgaacctgtttgtagtcatttcctaatccctggtccccatgactgggtctgaatagaataaatatttggaaagcagacttcattatatttatattttcctgtgtttgggactttatatagtggactattgtgttcgttttgtgacaagtagagaagagattgcattctagggatggtttttgggggaacataatagtagtcctgtttatggctctccttgaattggttcatctgtgctggtgactggtattttttaccaaaccttgtctggtgagcacaagaaaaagaatttttaaaaatctactattaaaattgagatgatacattttcacataataatatttgaagtagtgaaccgtctttattttattttatctttttttttggagatggagttatttctcttttccttgggctcgaatgcaacggcgccatctcagctcactgcaacctccacctcctgagttcaagtgattctcctgcctcagcctcctgaatagctgggattacaggcgcctgctaccacacctggctaatgtttgtatttttggtagagacagggattcttcatgttggccaggttggtctctaactcttgacctcaagtgatccacctgccttggcctctcaaagtgctaggattacagacatgagccacggcctgacctgaactgtggggaaaagaaagagatatcagattgttactgtgtctgtgtaggaagaagtagacataagagactccattttgttctgtactaagaaaaattcttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtgcccagagacacactacactgcggaagactgcagggacctctgcctaggaaagccaggtattgtccaaggtttctccccatgtgatagtctgaaatacagcctcgtgggaagggaaagacctgactgtcccccagcccgacacccgtaaagggtctgtgctgaggaggattagtaaaagaggaaggaaggcctctttgcagttgagataagaggaaggcatctgtctcctgctcatccctgggcaatggaatgtctcggtgtaaagcccgattgtatatcccatctactgagataggagaaaactgccttaggactggaggtgggacatgctggcagcaatactgctctttaaggcattgagatgtttctgtatatgcacatcaaaagcacagcacttttttctttaccttgtttatgatgcagagacatttgttcacgtgtttacctgctgatcttctctccactattatcctattgtcctgccacatccccctctccggaaatgcccgataatgatcaataaatactaagggaactcagaggccagtgctggcatgggtcctccatatgctgaacgccggtcccctgggcccatttttctttctctgtactttgtctctgtgtctctttcttttccaagtctctccttccacctaacgagaaacgcccacaggtgtggaggggcaacccatcccttcactgaaccatttttattctttcagaaatgtgattgataacagtaaagccacactactcaagtgcctgaaatacccctcattgtcttcttcaggtggcaagggctctggaacagccacataaaggtgagggcaatatttttactgtagttctttcattgattggttgattgatttttttctcttagagggttagcatacatttatctgaaattgaaattcaagaggagagacaggcacctgtactagttttctcttgctgcctattatcacattaccacaaaccagtggtttgaaaccacagaagtctggaatgaagtggccgggttctctgatcagagtcatgtgaggctaaaatccgggaatgggctggctgtgttttattcctagagctcaagctatttttccaggttcactacagataatgaaagagttcctattcttgtttgtggggggctgagggccctttttctgtgctggctgtcagcggggagacactctgactccagaggccacgtgctttcctccttacctgtctgtttcatctttcaaccaataacaactcatggagtccttctcaagctcccaccttctctgacttcatcttctccaaccagccacacaaagctctgtcatgtatggagtgatgtgattagatccagttcatgcggtaacctcaccatcttaaagtcatataactggcatataacaacatagtcacaggaatggtgtctcatcaccttaagaggctttagagacaagggtgtggcatgtttggggaccatttcagaaattccatctaccacagtaggacactcacattcccccatctgcaaagtgcatttaccctctcccctgaggtttccagatttcatgtcattaaagcattagttcaacatgaaaaatgtcatgtagaccacatcagatcaaaagtttaaaatcccatctaaaacatccacaccaggtgtgaatgaggcttccgagagtgtccattaagtgcagatccttgacataattcccttacctctgtcgacctgtgaaactgaacaaacagcttatctgcccctaatgtgaaatgatgggacagacatagaataacaactacagtgattctagttcaaaatgagggaacatggaggggataaagaagtcactaacccaaaatagtttggaaatggagctgggcaaaatccagcaggagtttcttagttaggatccacagcctgggactgaccctctgtcctgtgggtctttacctctgggctctctgctctgcatttcttgaaaccattattatttatcattttcctcacactcttttgcgtatggctcctattgcactcaaaatgtttttgagattcatccatgttgttttgtgtgtcaaaagtttgttcctttagccattccatggaatgaatgtatcacagtttattgatccattcttgtattgatagatatttgaatgtttccagtttttcctattatgaataaaactgctatgaacattcttgtataaatcattttctggacatatgttttaatttctcttggataaatgcttaggaattagtgagtcatagaataggtagatgtttagttctgtaagaatatgccagacattttttcccaaagtgtttatactattgtacattccaaccattaatgtatgaaggtgagaaagcttttgctacttccaaagaggcctctctatatacatgtaattttttctaactggagacaggctgatgacttcagggacatgagcatgggatacctgtcatcaccaccaccataaagttgggattcaggaaggaggttaatcatataaagaatcctgtgaccagtatgagcttctctcaggccacacagggcactcaagtgaacagggcatgggggccctggggtcatggtaagaaagtgtctcattggtaaaaccttttcctctggggaggtaaataaatgatttgtttcttcttggtagcccttgaagataaggatggtcaaacaaaataatatcatacctggagaaactcagatcttggtaagatttactggttgggaatccaaagttaatgccaagaagcagccgccagttgggatcaaatgtgagcctatggatcaaggtgcgtactcaaacacagagagctttgtgaaagatgctaccagtagtttttccagggcagagatgggtcctttatttttctctctaatctagcccatatgcttagctgagttttcttcgtatcactttaaatgatgatgtcccttgttcaacaattttctaaacattctttagataataattttatgggcattctttattgcattaggcttaaatttaatgcatcttaaggttttattgcaaaatattgccttgtttcctttttaagatgatacagtttataatatgcaaatttgttgtctgtcccctccctttatgtacatagaaaatgagcaaacaggtggccatgaaacagatagtcatagaattggttcagtggttgtgagtgcagcaacccaagagtgtcttatctgaaataccaccaggaatgtctggacacagtagacaaaggtttttcaactggacgccttaggatacatgcttccaaaaacaaagtagccaaaaagaaaccagagtcacagaatatcagagccagaggaacatttggaggtaattcagtacctcctccttttcaacctacaggggagatagtggaagagaagcagggatgggtctgccttctgtgcccacaattcattggagattgttgtggtgaagaatttcttttatgataaaggagaaataaactcccatcagctttaattcaggcaggtttattgaaaaggtgaagaagcgtcttgcagaagcaaagcatggctaaggcttgtgggctctgtctggacaaatgagcagccgacagtggctgatgctgcccctgactctggagccgtgcggtctgtggttctctgtgagcatctcttctattctcttgcaccttccctcagcctggcagtctctgtgtactcttcaacccataattgagcgaggctgtaccagccccaatgccatgtagcactttatttcaaattagaaaggcatgaaataaactagccctttataatacaactgttggaacaacagttgaaaataacaatatcttgactcctggttgagtgctttacgctgagctttcttttctgaatatgagcacagacttggggatattagtgtcacctggcattattagctagtattctccttttgtttccccataacatcccctcctccttcccacagatccactctccactcatttccatcctgtcttatgccacttggggcttgtcccttctagaatgcatccctggctcccctgtgtgcacacttgtagttaggtttagcattgggggcacccgatggagcctggaagtgagaggaaggtgaggtccgtatttcttccctctccctccctgctctggcactgagtatctggcaatagctgcatctgtctattacttcagtggccactcttccacagccccaattctcagtgggtcccatagcattatttacctttgttcctttagctcccatcaaggaagacccagaggcattctcctcaccaaggcattaagaaatgcatgggtgaggggaacagcggcgtgcgtgtaaaggtcctgtggcacctctcctctgcaggctggaggtcatggcgggagatgctgcatggatttgtcctccctgctgtcagaacaacagggttctggaagagtagaggacaggccgtgggacttggctgtctagagacaaggcgggagggatttccttgagaggcagggacatgtggtggttactaatcattgtgaggtgtctgggatgtaatggatgggaaatctactaagaagtcaacttatgtaataattagaaaagctctagttctgaggacagagacctgttggagtcaccatagtgggaatttttgacctggcatccagttcagatacctggagcttcttgactgaggggagattggatcccttggggaagagtgaagccttcaatgctgccacaagtgtgatccgcccgcctcagcctcccaaagtgctgggattacaggcgtgagccaccatgcccggcctcttttttatatttaaaaaatatcattttatatattatcagggcaaaagagaaaaaccgtatgattaccttgtcatacacagtaaaagcatttggcaaaattgaaaacttttttcatgatttataaaaacaaaccccagaaaatgctcagcatgatgagaacagaaggcaacacttccaaccccattaagggcagatttgaagaacccacaggtaacattatattaaatggcataagattgaatgcttttctattaaatcagagaaaaaagtagaatacctgttgttactcttttaattcagcattatactagagctctaaatcaatgcaataaagtaagaaaaattaataaagtattgaaaagaaagaattgaagctgtctttattcacagataatgactgtgtttgttaacaatgctagaaatctacaaaaatctaccagaactaatcagtgagtttagtagtgttgcagaatgtaagctctcaatataagtggtcttttgtatttctgtatattagcaatgagcatttggaaaatgaaataagaatacaatttcatttaaagtaacatctaaatacatgttgtgcttataaataaattcaacagactgggcaccgtggctcacacctgtaatctcagcactttgggaggccgaggtgggcagatcatgaggtcaggagatggagaccatcatgcctaacagtgaaaccccatctctactaaaaatacaaaaaattagctaggcgtggtggcatgtgcctgtagtccagctacttgggaggctgaggcaggaggatcacttgaacctgggaggcagaggttgcagtgagccgagatcgcatcactgcactccagcctgggtaacagagcaagactctgtttcaaaaaaaaaaaaaaaaaaaaaggaaagtcaacaaaatttatgtaaggccagtacaccaaaaactacaaaaaattgctttgagaaattatgaaagaactaaattagtggggagataaaccttgtcatggatcagaagagttgttatgtttaaaaagtcagttcttcgtaaattgatctccagatccaatgcaattctaataattccaagcggcattttggtagaaatttacaagctgattctaccatttatatggtaatgtcaatgatcaagaataataaaatagcaatattataaaagaataatggcgaatgaattcactacctatttccagaattactctacagctatgaaaatcaagattatgtgttttgttgaaaaaaaaaatggaatatatatcagtggaagagagaatccagaaatagatactcacatgtatgtctaattgattcttaggacatatatatatgtatacacacacacacacaaacgtgtgtgtgtgtgtgtgtgtgtgtgtgtgtatatatatatatatatatatattcaccgttttgaagattatcatctccaaatagggaatatatatatatatatatatatatatatatatacatatacagacacacacaaacacacacacacacatacatattgcagtctgataagataaacagcacattgaaacaatttctcaaaagacttgaatagatacttcagaaaagaagatacatgaatggtcagttagcataggaaaagatgctccactgtttagtcatcagggagatcaatcagtgcaacaatgagataccagtacatatccataagaatggctaaaattaaaaaggctgaaaatagcacctgttggtgaggatataaagcacttggaagtcttatacttgtaggaatgaaaaatggtatggctcctttgaaaatctaacagtttcttaaaggttaaacataacacaaatcagatagacagtcattcccttcctaggaatttacacactgtgtctgcacaatgatctgtatgtgtgtttccagaccaacctgaggggcgggctgctatttctcgtggctcagtaacaagacacagatgaactggggaggaagagagttttgacttctgcaactggttacagggaaacggcctggaaattatcaccagaccaactcaaaattggaaagttttcctgagctaatgtaccttctaagctatatgtgtatgtggaagtgtgcattcatctaaatacataagtgattaacttcttttaatctataactaagtctgagtcctgaagaccttcctctggaacctcagttaaattcagttaatctaaatgggtctaggtgctgggggcccttatcttgtctcctgctaaatcacagaggtttggagagtcccttcagatctccaataaacttgtttgtggaggcctggggagtttcttcagacccccagtaaaacttatttaatactaaatggctcctgttaagaatgccttcgttatttcgtcatgctttaaggcccaggaaaaacctaggcaaaactcttggtgggcttttgttacattccagcctttgtataagggcactggcttctttttttttttttcctcttaatatttaattgaaccactcagtcggtactgaaacagttgttacggaggcctgtgttagtgagacctggcctgccacgtatggatgctcatgatagtttcttcataatagcccaaacgcggaatgatagaaatgtccaataacaagtgaaagtacaaacatacatggtatagccacacgaaggaatactactcagtatttacaagacattacagatggattttaaaattacattgatgcatgaaagaaggcaacacaaaagaacacaggtatcatttcatttatagaaaatggttaaaaatgcaaacggacctgaagtgacagtggctccttggggctgagggttgaaaggctgatgaactgcaaaggggtacaagaaactttggggcatagggaatttcctctatcttggttgtggcagtagttccgttagtgtatccatttgtaaacgtgcattgaattacacattttaaagtggtgcagtctgttgtaccgaaattatgcctttataaagttgatttcatcatcttaatttctccatactagcaattagcagctagaaaatgaaattcaataaaacataatagagattaatagccagaatcattacatgcttaacaatacatgcaatgaagcaggtacaaggcccctaaaagcaattggtgagaaaaattaaagaaggctaaataaatatatatcatgttcattgattggaagactcaattttgttagcatattacatcaacacaattctgattaatatttctagtaggagattttagagaaatttgaaagctagtttcaaaatgtatttgaaaatcaaagaacctagaataagcaagtcggtcttgaagaagcaataagttggaggacttactctgctagatttcaaacctgattttaaagctacagtaattttaaaacagtagtaatggtgtaagtattcataaatatatcaaagtaaaagaatacagattcaaacaatatgcccacatatgtacagttattgatttttttttagtagaatcttttttattcataaaaaatccatcaaaacaaaaaagttttccagccacacacaggaggggtatgggtgggggaaggtgtctgtccatctatccctggcccccagcccatgtggttttggcagcaataaggtgtgtggggtaatgacccctgaaattaaaatggtgtgtgtatgtgaaggaaaggcgggcaaagctatggggagcggtggagtggaaggaacaaaggaggtcagtactgggaacgctgaaggtgggaggccatttcataacattacttgttgatgaaattgccatgaataccttctttgcccatcagcaggcctagcgtcttggcagtcatggtgacaatgacgttgaaggtggggactccaccgatgctcttcatatgaagatccacggtcaattccccatcctgcagcagtgagtccaggaccacagtatatttctggccccccagtgtcagtccattcatgacaaagtttgaccagtctttgccaaccaggacaccaacctcagctggcgtgatgttgaggaaggttttccctgggatggcggcccagatggaaggtgggtccttgttgccaacaatggccgtgtcctaacaggtcccgtccgccacgaggctgtagatggaggtgtccacctggccgttgcgttgctgcaggggctcctctggtcgctgctgttggggccgcctgggctggcgggtgggggaggcggagagctcgatgcaggtgctgtcctcctcgccacgactctgctagctgtgcagtagccctcgctccgccacttaaaaaagaaaaaaatatatatatataatatatatacacacgtgttatatatattgtataatatatatacatgtatacatgtatatatgtgtatatatatatacatggcacacgtgtatatatatataatatatacacgtgtatatatatatataatatatacacgtgtatatatattaataatggcctacatctatattaataatatatattattaatatatatattatatatattaataatatatatacacgtgtatatatattatatatatatatatacacgtgtatatatattatatatatatatacacgtgtatatatattatatatatatatacacgtgtgccatgtttgtttgctgcacccattaactcgtcacttacattaggtatatatcctaatgctatccctcccccagccctcaccccatgacaggccctggtgtgtgatgttccccgccctgtgtccaagtgttctcattgttcagttcccacccatgagtgagaacatgctcgcaccgccgcttctaaatgttttaaaaacaaagacaccaatgcccttcattggggaaatgaaagacttttaagtaaaacaattttgagtgaaataatatttgttgttttaaaaagttaatattaaccactctccatcatatattgaaattaacttaagatgtgaaagttaaattagaaaccttgtaaaggaaaaataggaaatagtttcatgaacttgacacaggaaaatatttcttagactagatactgtagcactcaccacaataagaaatcaagcgaattgcacttcatttttaaaaagcttctccttattatgttgttgtttaacaacttaaacgctatctctagaccaggaataattatttgctatataatacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggtgtagtttaaaagactgaaaatattaagtgtgtgggaatgtagagcaactgaaaatggcctacatctttcatagaaatgtaaaacaatacaaatactttgcaaaactctgtccaacattttctacccattcaccaagcaactccatccctagctatagatacccaggaaaataagtatgtatcttcacagaaataattgtatgagaatattcatagttacttatgcacagtagttaccaagtaaacctgtctcccatcagaaaaatggatatcaaattgtgtgataatcatacaatcaataggatattacttggccaaaacaaaatgaaacaagggaaaaacacaatcaaacaaattagtggcatatatacccacctgagtaaagagaagtcggccgggtgcggtggctcatgcctgtaatcccagcactttgggaggccgaggcggcagatcacgaggtcaggagatcgagaccatcctggctaacacagtgaaaccccgtctctactaaaaatacaaaaaaaaaaagaaaaagaaaaattagccgggcgtggtggcgggcgcctgtattcccaactacttgggagtctgaggcaggagaatagcgtgaacctgggaggcagagcttgcagtgagcctagatcgcgtcactgcactccagcctgggcgacagagtgagactctgtctcaaacaaaaaaaaaaaaaaaaaaagtcaaaacaagagaacatactaaatgattctatttttttatttatgatttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttattgcaactgcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacagtaagttaagaatttcagttacttacatccctcagtcctgattaaacctatttgatttcaccagtttttaacccatcatatgtttgggtttcttctccccagtccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacagtaagatctataggctcaccgtcatgaaagtgatgaatgatgtcctgtcttctctctgagacactaaatgctctctccatcaaaaataatttcatccttcctgtacttctaggaaaacagaaatgggtattttaacattttgttaaagttggaagacagaggtaccaaagtatttagcaactttccatgtttgcaatcaggtgggggtgggactagagttaaactgccatttattgatttctgacacaggcacagaatgacctgttttctccaagaggctcaatcatgttttcaagaatcctctctgtaccatataagatcctgcagacaaataacatctagtctgttgttctaaatgtctgagactagtgaacttttcttcagttcaagtttctgtggaggcccaacaggcaaagctctgttctagtgactctgagggaaacttggtgatagtagccagtacctgctctgaggggcttcaagaggagtctactcctaatagaacctgtgctgtctataagtgacagcatcaagagcagggagtaggggccgtgcatggtggctcactcctgtaatcccagcactttgggaggctgaggcgggcagatcatgaggtcaggagtttgagaccagcctgggcaacatggagaaaccccatctccactaaaaatacaaaaagtagatgggcgtggtggcaggtgactgtaatcacccctgcctaggaggctgaggcaggagaatcctttgaacccaggaggctgaggttgcagtgagccaagattttgccattgcactccagcctgggcgacagggcaagactgttaaaaaaaaataataataataatgataaataaaaataagaataaaaagcagagagtagcttggtgagagtgaagtcctgcttcctggggcacagagtcttgttgctaaagaggaagaaagatcgcatccgagaatgtgtggagatagcagtgcagtgtacagagcagggactgtgggcctgtctactgggctccatccaagttgcttgtcttgtctgtccctcagtttcctcacctgttcagagggtactacaataatacctacctctgtaaattgctgcagtgaattacatgagctatttcttgtcaatctcctagaacatttattggcacacagtaaacactatctattagttgttcattctgctgtttctaaattaacacaaactttattagcatttgggcatatttccttcatggccttatggtgttatgtgtcactctttatgcttcagatatgattcttaaaatcataactgaagatatgatttaaaaatcaaagattttaaaaatctttcacatacttgtccttgaaattcccagtaaaagggaaaccatcagtcccatagtcctaggggccttcccgactgtacgagaaatcactacttcatgccccagtgcagtgttttagaggagaggctgcaaggcttgggaaagtggccccgcattcagagtcagacctcagggactgtgaattctgactccactttgttgtggttgaatcatcttgtcaacttccttgatgtgcccttgaggttctctttcttcatctctaaattttggaggatcagatgccagaaagtcaggagactgaagagtaaagatgtggaaatccctgtctagaccctggtactggggagagttttgtccttgggatggacctggctcctgtcctgtaggcaatgaccacagcagcatgtccagccttccactgaggcaggcgtgtctgtcttttctcagaatatgaagagtgcaaagatctcataaaatttatgctgaggaatgagcgacagttcaaggaggagaagcttgcagagcagctcaagcaagctgaggagctcaggtgaggggaccccatgggggcaggcaggggggcaggtgtgtaaatctctgaagtacagcagctcggtggggagatgtaagagctaagctgggccaggggaagggcaggaattgccatggcaggctcgctacacacaaatatttatcaaacagagaagaaggataataaaaatgtatgggttgcagttgtttctcagagccttgttttctctttttcaagcaagtaattgttgatgtgaaatttacataacacaaaattaaccaaaggagtgtgaaccacacagcagcattcagtatactcaaaatggtgtgccatcaccaccccacttacccttagtgagaatcacctcctgactgactgcggcttctcattctttcactcaatcaatgttgccttctcgaccctgtcattcttttcttctttcgtcttttcaattcaccccatctgcacctggcctcatttctgtacatggctttgtatctagtggccgcaagatgcactatgtgtattttcacatggaaatgtccatggccagaggaactgaaaggatgtctttttgaaacggaattaggaagacacctacttttgtttacagaagagaaagatgaatggaacatcatcgaggatcttgcaggagccctctctgatacagaggaagcctgtaaaccattttctattctttctcttggccacagacattcctttaaacatgtgctgaccttctgcttcgaggtctccttgaggacattgtctcagaaatctctgttgcaatatttgagcggatcactcaaccctttccactcttaaattttctctaccgtctcaccttaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccaggtaaggtggccataggccctgatgacccaaaatcccaggcttatgagagactccagacctccatactttcacaatgacagttgtatcaatggtgtttttttccactaagcttatgtggccatgacatgaccaggacttcttgggtaagaacggagatgggaaacccatggggttggaggtcacagtattgcaagtgtccctcctcccttgatggaaggtggtctttggagtatgaggcagcatctgtctagttttaaaggacaggaaggaggctgcgatgggagcaggcttgttagagtgaaaagagctctggactaagaatgaagattcccaggctgtcttttcggcaatgttcttagtaactgtcagagagtgaatgacttgtccttcctgagtttctctctctccgtggcagacaaattgtctcttgcaagggtctgaagcattcaaatgtgggaacacttacaactgctttccaaaatgagatgaaggccctcaccgtgtgatgttggagaaggcactttatgtgggggcgttttgtggtaggaagtgcttcagactggagcactccccatggatagaatgtccctgaataacacagcagaagccacttggaggcttgaaatcttctgatgcatagaggactgtgggacaagtttgtctgcttctaagagaaagaattaggtttgaaatgcaaactgtgacgggacaccaagcctgtgcctgggaatcagatctggcaggatgggggagacagctgccaatgtccagagagaggctgcacaagcctccagtgatatgggaagcaaaaggtcttttcaatatttggccacatcttgatggtggccctccagatcagaaatgcattgcctgatggatcaggaaaccatgccagggcattctgttaaagataaaacatgagagttttcagttgaacggtgacccatgcctagatgttcatgtctctgttgcacattgggctgactgtgcttgcagactgtgaagtgggaaatatctgaacgaacacttctgtatttacagaaaatgacaacgatgacgatgaagatgttcaagttgaggtggctgagaaagtgcagaaatcgtctgcccccaggtaacactgaatactcaggaacaattaatggatggtaacatatgaggaatatctaggaggcacaccctctctggcatctatgatgggccaaaaacccgcattcgcttggccacagtatgtgaaatataacccagcttagacacagggtgcggcagctgtcatgtttctctgtgtgtgccgagtgtcatgtctgcaccgtacagggatagctgagtcttcatcctcctcagctcctatctgtccagtgcaatgaacagcagctgctctcttcctctctggttcccatggcagccatgctctgttgcagagagaacaggattgcatgttccctcttaatgggaacgtccattttgctttctgggaccactctcttaatgccgcctgtcaaaaccagctaggactccctggggtccaatccctctgtgtttaatcttctgtcatctctgtcccacctggctcatcagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccaggtagcctctgttttccttgtgtctcatacctctctctaggctgaggaagataaactctgaagacaggctctatcaacacaaattcatttgaataaaaaactgtgatgggtttctaaacagatatcagggagtttttttgtccttctcagctaatgtcatgcctttgtctgccagtccccagtatcaagttactcaaccccaggcaagtgtgacaatctcatagtcacctgagtgcaggaggtgcacaggccatatctgtcaggcctcctagcttcgattcagtatctcttgtcatctgtgattaagtcatctgtccctgaacaatgcccatggagtttctatgcctgtttaaggaagctggcagccttgcctttgtatttggaaatatcgttcctcaggcttcactgctctcagctttcatctggatctcctttaagtcagcttgcttagctgcacagtcaccctgaaatcaggacggaaacttttcttctttactttgctgatatatttccataaagcaaggctggaccctggttctccaccctgtcaatgcaatggctgatccaatgtttctttgtagcatcgtggattttttttttttttttttttttgcgatggagtcttgctctgtcacccaggctggagtgcagtggcaccatcttggcttggtgcaacctctccctcccagattcaagtgattctcctgcctcagcctcctgagttgctgggaccacaggtgcacaacatcacatctggctaatttttgtatttttagtagagacagggtttccccatattggccagggtagtcctgaactcatgacctcaaatgattcacctgtcttggcctcccaaatcacagattctttttaaagcaagagttgttcaaatttatctatcagtcgtgtttcatgtatagatgcctctaaacatttaatgtccatgttacctggtgatataagtccgtattgcagcaacactcttagaaaattgtttgaccaatttttggagatttttttggggaaaaaattttgtttaactttgactcaggcagggaatatgtcattatggtctacacgtagagggagattttggcctgtgggtctggaaagcagggtcatctaattctcaccaaagttaatctaggacaccctagaatattcctgtcagaatccttattcttgcactgagaatagttatgtccttgtgctatgactggacagtgatttgttcctatgtgaagtatgaattgcttaatgtgacctgcttctctgaatttatttacagaaaatgaaagtgatgatgaggaagaggaagaaaaagggccagtgtctcccaggtaatgttgtggaattgttggctgttaattcagtagtgacatctggagattgtagatttagggaaaatgaggaagtgatgaatagaactatttcttccattcacccagctacaaattgtgctgatttacaatgttgtatgttatttgtggcacttgtattggttttaatttcatagtcctctcaagataggaacttgccatcagatgagccaggtgaactagccaaacagggttttcttgttgatcttttcaaaaaaccagccctggattcattgattttttgaagggttttttgtgtctctatctcctttagttctgctctgatcttagttacttcttgtcttctgctagcttttgaatttgtttgctttgcttctctcgttattttaattgtgatgttaggatgtcaattttagatcttttctgctttctcttgtgggcatttagtgctataattttccctctacacattgctttaaatgtgtctcagagattctggtatgttgtgtctttgttctcattggtttcaaagaacatctttatttctgccttcattttgttattttcccagtagtcattcaggagcaggttgttgagtttccatgtagttgtgcggttttgagtgagtttcttaatcctgggttctaatttgatggcactgtggtctgacagtttgttgtgatttccattcttttacatttgctgacgagtgctttacctccaactatgtggtcaattttggaataagtgtgatgtggtgctgagaagaatgtatattctgttgatttggggtggagagttctgtagatgtcttttaggtctgcttggtggagagctgagttcaagtcctggatatccttgttaagcttctgtctcattgatctgtctaatattgacagtggggtgttaaagtctcccattatgattgtgtggagtctaaatctctttgtaggtctctcaggacttgctttatgaatctgggtgctcctgtatagggtgcatatatatttaggatagttaactcttgttgaattgatccctttaccattatgtagtggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgagtacagcacactgatgggtcttgactctttatccaatttgccattctgtgttttttaactggggcatttagcccatttacatttaaggttaatattgttatgtgtgaatttgatcctgtcattatgatattagctggttatttcgcccgttagttgatgcagtttcttcctagcgtcaatggtctttacagtttggcatgtttttgtagtggctggtaccggttgttcctttccatgtttagtgcttactttaggagctcttgtaaggcaggcctggtggtgacaaaatctctcagcatttgcttctctgtaaaggatttatttctccttcacttatgaagctttgtttggctggatatgaaattctgggttgaaaattcttttctttaagaaggttgaagatgctggagaggatgtggagaaataggaacacttttacactgttggtgggactgtaaactagttcaatgattgtggaaggcagtgtggcaattcctcagggatctagaactagaaatactatttgacccagccatcccattactgggtgtgtacccaaatgattataaatcatgctgctgtaaagacacatgcacacatatgtttattgtggcactattcacaatagcaaagacttggaaccaagccaaatatccagcaatgatagactggattaagaaaatgtggcacatatacaccatggaatactatgcagctataaaaaatgatgagttcatgtcctttgtaggggcatggatgaagctggaaaccatcattctcagcaaactattgcaaggacaaaaaaccaaataccgcatgttcttactcacaggtgggaattgaacaatgagaacacatggacacagaaaggggaacatcacacactggggcctgttgtagggtggggggagggaggaggggtagcattaggagatatacctaatgttaaatgatgagttaatgggtgaagcacaccaatgtggacatgtatacatatgtaactaacctgcacgttgtgcacatgtaccctaagacttaaagtattaaaatatatatatctgtatatatatatatatacatacacacaaaaaataataaaggaaaactatacatatggaaaaaaaaaagaatgttgaatattgctcccactctcttctggcttgtagggtttgtgccaagagatctgctactagtctgatgggcttccctttgtgggtaatccgacctttctctctggctgcccttagcattttttccttcatttcaaccttggtgaatctgacaattaagtgttttggggttgctcttctcgaggagtatctttatggtgttctctgtgtttcctgaatttgaatgttggccttccttgctaggttggggaagtcctcctggataatatcctgaagaatgtttcccagcttggttccattctccccgtcactttcagtacaccaatcaaacgtagatttggtctttccacatagtcccatatttattggaggcttgttcatttctttttactcttttttctctaaacttctcttctcgcttcatttcattaatttgatcttgaatcactgataccatttcttgcacttgatcgaattggctactgaagcttgtgcatgcaccacgtagttctcgtgccatggttttcagctccatcaggtcatttaaggtcttctctacactgttcattctggttagccattcgtctaatcttttttcaaggtttttagcttccttgagatgagttcgcacatcctcctttagctcagagaagtttgttattaccgactttctgaagcctacttctgtcagctcatcaaagtcattctccatcctgctttgttccattgctggcgaggagctgcgatcctttggaggagaagggatgtcaggtttttggaattttcagcttttgtgctctggtttctccccacctttgtggttttatctacccttggtctttgatgatggtgacctacagatggggttttggggtggatgtcttttttgttgatgttgatgctattcctttctgtgtgttagttttccttctaacagtcaggtccctcagcttcaggtctgttggagtttgctggaagtccactccagaccctcaaacagggatttcttggtgttgcctattctctcccatgtgtttaaatccagggagaggtgtatacatgctttcttcctatttgttggtagtatgttggctagtatttttgcaagaaaagaaattgaaaaagtaaatatattatatcaaaatattgggaaaatggggcccttaatacacaagatctgtgtctgcactgcgtcaagaactctcttcacttgaatgctgcatgtaaaattcaacccaatttatgcaaagtagttgaagccctgtgtcagttctctgtgctgcaagtcatgatggtagtttacagggagagtctgggtgccctgagttggctcatctgtggcaaatgtactgagcacatgctgcccatttttgctgtgtccccagagcagtcaccctccaccctgtatttagaaggatagttttatttctcttgaaggaaaaatgcctttggtttctgtgaccactccattctgtctcccatcagatcatctgggaggttttgttgtctaatgtctgttggttaaatcttctatcatccctgtcctgcctggctcatcaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagtgagtactccattgtgaaggtgataaagctccagttcatggcccaggtagaccccataatctttgggccttgtgccccttgttgggctgagatttgccatcaccgtgggctgaacctatatatcaatgtagatttcaatcactctggagtcgagtctgaagcacaggcatggggtgggtcagtgagctttgctctcttcctagtctcaggccatgcccgtgccaacctggactgactgtcacgacattgaactcaaggcaggtgtggcaaactcacaccaaactatgcagcacatgcccaggagctgtctgtcagctcagctcatctgaattaaatgtctcttgccagctacaaaattccttatgagttttgttcccaaagcatgtctgtgtggttctttacctgcccaaggccagtgtcacccttgtctacttctcagtgaaagatgtgacccaggtttcactgaatttattcccattttctgtgtcttctaagtgcgcttgttttagctcatctgtccatcatgttcctggtacgttttctagataaacggctgacttttcacccacaaaagccataatagctgatgcttctgtgtagaaccaagtttcattttgactcaagagctggtacattgcaccccttcatcaaatctctgtgtccacaatctcataaactatcaaattctgggtatttaatgagagaaagcttaatattgaagtatctctcctatgaggtgttagaactatttgcctacaatttattggggaaaaaattgctcatttgtgtacataaacctaggacagagcacatagggaagataacattccaaaacaggggaattttgcccaaggctcatgaaagaacccaagccagttttctcaagacttgacctcaggcctactggaatatttctctcaaagtctcctgttctcacactgacaagactgatgtccctgtgttaggattggacagaggaatgtttctgtgtgcaaggaagaactgcttaatgtaagagggcccatctgaatttatttgcaggacatcggtgggatcaagtgaaaaaggaggaccaagaggcaacaggtcccaggtgagtctgagaaattgtggacagttaatttgatgttgacacctggagatgccaagtccagggaaaacagtacatgctgaaaataatgattttgtcttgtcagacaagtctgaattatgcctactacattgctttttggttctcattagagtaaatgtttaggtttccatttcttcctacacttatcatttactaacctagtgaaggttgaccatacctcaaaagctgtattctcatggtaactgcagggaaacttgagcacattttatgcaaaattattgaggacatgcttttcatgatcactgttcactgtgtgtcctgagagcacaaatacagagtgtcctttgattccctcatcagtgtgtcacctgaccaattcactgagctcgctctgtgtgtgtgtgtgtgtgtgtgtgtgtgtgtgtgtctttctctttcatccttttctacctggccctagtctatcccaacataaaggcaataatttgttacctcattaatggatctgtcctttttcttttcaaactcttccttatgttagccatgaaatctagctgggactgtgtggtttctgattccccctggcttattctttactttttcccacttttccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatggtgagtacctttctatgaaggtgataaggatccactgagtcttctggttagggtcatattcctactgcaagtggcccttactgagctgagagatgtcattgccacagggaggacctataggcacatgtaggttgaatgaaactctagttccacttggaagcccagacaagggatggatcagtgagcaaggctctcttcctagtctcaggccatgcctgtggcgccctaatcctactctcatgacgttggacctgggcagatgtgacaaattcacacaactctgattttgtctcaattttgtagatcttgtagatttcatccttcactctaatttcagcgtctaaaatcctcgctaccgtgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcttgaagaatatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattgtgtgttgacacctggagatgccaggtccagggaaaacaagagtgtgttcaatttcatgttttcaacgaaggttgaattactcctcctgacattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgaccactgttcgttgtgtgtcccgagcgcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaatggatccgtcctttttctttttaaacagttccttatgttagccatgaaatctagctggggctgtgtggtttctgattctccctggcttattctttactttttcctacttttccaggctcagcagggagctgctggatgagaaagagcctgaagtcttgcaggactcactggatagatgttattcaactccttcagattatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcataaaggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgagaagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatcactgtatgctgtgtgtcctgagggcactaactcagagtgtcctgttactccctcatcagtgtgtcacctggacaattcactgagctcgttctctctctctgtgtgtgtgtgtctgtgtgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaattggccattactgagctgagagatgtcattgccgcagtgaggacctataggcacatgtaggttgaatgaaactctagttctacctggaagcccagacaagggatgggtcagtgagcaagactctcttcctagtctcaggccatgcctgtggcactctgattctactctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaaattgattggaaaaatatggcataactgtttgcacaaacttgggacaaatgttattgggataacgatctactagaatagggacactttacccacagtttctgggagaaaaactgaggaatttatatcatgaccagccttcagacctcctgaaatatatctctcatggtgtcgtattcttatgctgaggagcctgaggtccctgtgtgaggattagacagtggattgttatatgtgtaggggaatcagcttaatgtgtctgtccatgtctgaatttattgcagaaattgaaaagaaggggaaggggaagaaaagaaggggaagaagatcaaagaagaaaagaagaaggggaagaaaagaaggggaagatgacaacccaccatgccccaggtaactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacgtaccataggttgaccatacttcaaaagctgtactctgatggccactgcatcaaattttgagcatattttatggaaaactattgagctcactctttttgtgatcacagtttgctgtgtgtcatgagggcactaactcagagtgtccttttactcccttaccagtatgtcacctgggcaattcactagctcactttctctctgtctctgtctctgtctctctctctctgtctttctctttcattgttttctacctggccctgttctatcccaacataaaggcaataaattttttttttttacctcattaatgaatctatcctttttcttttctaaccacttccttatattacttctgaaatctagtggggctctgtggtgtctgattttccctggctgcttctttagttttgtctccttttccaggctctacggcgtgctgatggaagtggaagagcctgaagtcttacaggactcactggatagatgttattcgactccgtcaatgtactttgaacaacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagaacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacattttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttccatgtttattttctaatctcttccacattgtaggctatgtttaccatacgtagcagaatgtatttacatttcttggttctagtcatttgtattcttcgtgagtgtgagtgtgtgtgtgtctgtgtgtctgcgtgtgtgtctgtgtgtgcctttggcatttaggaagggttgtatagctcatgttaaatattgcactaaaaatgtttttgatggttttcctccctttgaactagacacacttctaatatttggtttatagttttaaattataactttcagcatcaaatatttccatacaacagtcaattacatgatgtgttttctttttcctacctcctttacctgccccttctcataatagtatttgaacctaaacatataccgttgacattctgtgattatcatcttgcccctaccttggttttggtttttggtgcagttccaggctcttggtgtctttgtttgggacaccaagagcctggtactgccacggcaccagctggtaagaattaggcttttttggccgggcgcggtggcttatgcctgtaatcccagcactttgcgaggccaaggcgggcggatcacgaggtcaggaaatcgagaccatcctggctaacacggtaaaaccccatctctactaaaaataaaaaaaattagccgggcgtggtggcgggcgcctgtagtcccagctactcgggaggctgaggcaggagaatggcctgaacccgggaggcggagcttgcagtgagccgagatcgcgccactgcactccagcctgggggacagagagagactccgtctcaaaaaaaaaaaaaaaaggctttttttttccctaagggttaacaacaaaccagccctttggaaagacttgcttcaccactgttaccaaccaacggcctgatgctttccctcagttttgtgattttgacaaaacaagcaagcagcattccctcctgataagagaccaccgacctaggaatgattctggccagactagagaggatgcacagtgagggttttcatgtcctctgcttcagcttttgatgtcagagggccacaaactccactctcagatgattgctaatgccaccattttatgaacatggaccccatggagaggcacgaagctcaattgcacttctgcacatttttcctcctataaatattgctattggaatattatttggtacggctcccgtgaaagatacatttgcagaatgtactcaaattagaagcatcatgtaaagcctataatgtagcgatagtgcatcaacttccctacactatagaaatatctgcggtgtagacatttccacaatgaccagatatgtgtacaacaaaggtggctgcagcattctttgtaatcctaaaacaatgaaacctacctcatctcaaaaactttatttttttatttttattttttttttgagatggagtctcgctctgttgcccaggcgggagtgtagtggtgcagcctccactggtgcagcctccactgcagcctccacctcccaggttcaaatgattctcctgcctcagaatcccaagtacctgggattacaggcacatgccaccatgcctggctaacaaaaacattttgaaaagggttaaataaatcatgcacaaactgaggaaaaatactcttcaaaaatgatggagaggatcactatgatgatgaatgattccactggtcacattattgatagagcaatcagtaaatccaggcacatcctcgggatattactgacctcctattattaacatatgaaaaaatggaggcatgtaaattactcgtttaagcgtataacggactgaattagaattttatcacaccagaagtgggttcctaggtctctgtttcaggattcctgagttacacacatataaacccaggatttcaggagatacccggttaagaatccggtcggggaggtgggctggcccttgacatggataagtcacaaattagtggcttaggactccaggaagataaaatcttccccatttatctagtgattgacaatgcatgaatactttaaaagctcaaacaagcgtccctgggtgggctcgaaccaccaacctttcggttaacagccgaatgcgctaaccgattgcgccacagagacaggtactgtcagttctactgggcgctataggaagggcgcacgcacgaaacttcctccgtcccttgcaacctcagggcccgcccggcaggacgactgagcaaggccttggaaaaccggagagattggagcggtaagtcgcgctggtcacgttggacacctgcgcgttgggagattctggagccagaaggatagccgaatggccttcgcccgccctgcccctcgcctgcttcagaaaccccccggaaacgtcccggttgagaccccggcccgagccgcctgggggccctagggaggctgaacgcccggtggctcccgggatggctcttcccgttcttcgcgccgccttcacccagtgagggagcctgtgccctccctgcccagtcgcttttggggccgctgcggagcttccgctgccatcttcggatcctgtgttccgcacgggggctccaccagggcagggatcgtggtgagggtggctcgtgggtccccctcgcggggagcagggtctggcactcaccagggcgcaggactaggacttgtcgaatgaatccatccttttagcttttagtcctttgaagagccttgagaatggaaatcatgagagatttttccatggggaagttccttttacaaagcatttatttacgtggacttcttggcaccccgcggggcggcaacgggcagggcctccagtgccccttctgcgccgtggagccgcgggggctcagctgggcggtggtcgggtcctgaggccggagggcgggagcaggggaggggaaaagcaaaagcggggaaagaagccggggagcggtggaccagacgtccagacctcctgaaaggctggcggggaggcacaggcgggatcttccggaggtgagaatttttttttattatagcagaatggggaggaattgaggggaaaatggagatagaacctgaaagagccccaaacgccagaacctgtagctccccaagaataagatcttccagaagaactagacccaaaactagccgttggggaacaccgaaatccttggaggagcaacatccgcatgaccctctgtgttcctttaggcaaaaggacttgcttccattgtttgttcaattgtttgtgtttgttaaataaataaaacgattttcatgtatctttgaaattactttggcgctactattttatgattgcaaataattcggcagtgatcattcttgtacacttctcattggccatttgtgtatttctatagggtagaggcctggagagcagttgctccagcatagggattacacagtttttgtttgtttgtttgtttgtttatttatttatttatttatttatttttgagacagagtctcgctctgtcacccaggctggagtgcagtggcgccatctcagctctcactgcaacctccgcctcccgggttcaagcgaatctcctgcttcagcctcccaagtagctgagattacaggtccgcgcgagccaccacatcgggctaatttttgtatttttagtagagacggggtttcaccattttggccaggcaggtctcaaactcctgacctcaagtgatctgcctgccttggcctctcaaagtgctgggattacaggcatgagccaccgcacccagcgattacatgttttttttttatatatcattctattttctttccttatttggcttattagctgtaactctttcttttgttatgtcagtgatggctttagggtccctagaatacatctttatccgtctgccatcaagtgacattatacctccccttctggcctttatgctagtgttgtcagggaatttgattttggacatgttataaaccccaacatccaagtacgtacatagcgattttcagtcgtctccatttctttgtgtaggttcagatttctgtttggtatccttatccttaggcctggaggactcctttaatatttcttgtagtgtggttcggtgaattctgtcatttttttgtatgtctttaaatgtcctgatttcagtcacatttttgaaagatatttcaatttggcatagaattctagaataactttttttctctcagtactttaggatgttgccactttgacgctttgtcattgacatatctttcctgtttttgtaaacttggcataaagtgggtttcctgtacttgttatatgatttttggattgtgtattcaaattaaaagtattaaattaaaattaaaatggcctgggcgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtatatacacataaatatgtatatatattatatgtatgtatgtatatataagtcctacagtcaccttaagttccaccaacagtgcacttaaagtaaaatgtgcccaacctgaggctcaaacctacctgctggcacgcaatttgtgtttgtgagacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaacaaacttctcagttgcatccctggaatccatggaaagtccaggagagacaatcaagtgctacaggatcaagcccaaacagaacaggactaggcatggcttcctcactaggagtcaggccaaagtcatctcctttggtctccaatggaggccagaactcggttcacctgcaacgggaggacctggcccagaagaggtggccttcatcttcatggtgccttcagataggaaatctaggatttcttttcttctctttgatctacttccaactctccctttctatttatttatttatttatttatttatttatttatttatttgagacagagtcttgctgtgttgcccaggctagagtgcaacggggcagtctcagctcactgcaacctccgcctcctgggttctagagattctcctgcctcagcctcctgagtagctgggattacaggcgcctgtcaccgcgcccggctacttgttgtatttttagtagagacagggtttcaccatcttggacaggctggtctcgaactcgtgacctcgtgatccacccacctcggcctcccaaagtgctgggattacaggcgtgagccaccgcatctggccctccctttctatttcttcaagacctttttcggatccctcctgcgcaggacctaaacgggcggtgcccttacccactggtccctccctgcctggtgtcttcggagccctagctcacccggaacgttactgcccgccggtgacagcgagaggaccaaagaggaccaaagagggcagcgggtgtggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatcccgcctttatcaggagattcctttgccaaagttcagagaactggggttcccgctgcttgccacacagaaaaccgatcactgagacggttattgccaaggaagaggctttaatagggtgctgcagcggaggagatgagaactcagtctcaaatccatctccctgaccaaccaaaattagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacacggtgaaaccccgtctctactagaaatacgaaaagaaattagccgggcgtggtggcgggcgcctgtagtcccagctactcgggaggatgaggcaggagaatggcgtgaacccgggaggcggagcttgcagtgagccaagatagcgccactgcactccagcctgggaggcagagggagactctgtctcaaaaagaaaaaaaaaaaaagaaagaaaagaaagaaaacaggaactagggaggggcaaggaagcaatcaggatgaatgaggggtccggcgtctcattgtctgggtgactttcagttctttgatatcttttttgagaggcctgaaggaaggaactcaaataaaacaaatatcgagtttcaaactttcagatcagaagggtccatttctatgtttatccaaaaatctacgtatgggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggagtttgagaccagcctgaccaacatggtgaaacctcgtctctaataaaaatacaaaaattagccgggcgtcatggcgggcacctgcagtcccagctactagggaggccgaggcaggagaattgcttgaacccgggagatggaggttttaatgagccgaaattgcgccactgccctccagcccgggcaacagaccgagacaccttctcaagcaaaaataaaaacaaaaagctgcaggtggaaaaaaaaaagtctggattttggttcagagtccctggggccttcctcagtagttttctctttccttaaaaaaggaagcttgtctcagtctctgcatctctctgagtccttttggagattgaggatggtgaggtctcagtgcttggcccccttctaactctgggtacctcccctcccgtgggtcaacctggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgtctcttgtggaggaactgacacccgctggagaaagtgtggagggaagcgagggctgcacctgcacgcaggagctgaggcaagcggcggttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagacttagcagggtattccgccaagacataggttagactgcggttctgatctgcaggcctcgatgccctgcgccggggcaccagggcacgggcaaagccctccccctacacaaagcaagggtgttatgcctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgcaatcccagcacttcagaaggctgggcggaccacttgagcccaggaggtggagcccagcctgagcagaatggtgaaactgctacgaaaaaagaaaaagaaaggaaagagaaagaaaagaaaataaaaaaaaaaagagaaaaaactagccgggtgtggtggcgtgcggttgtcctactcgggagcctgagatgggaagatcgcgccagttctccagcctggacggtacagcgagacttgtcttagggagggggggaaaaaacaacaaaaaaaacagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaaggaaaactaaccgttgcgaacggaaacaactgaccggacagaacacagccacaaaacacgagcccgcaccctgagttacaaaaacacttacggctcacctactattcgcaccacagaagcaccaggggaaagcgcgaacgcagtcccctactatcacaagttatgcagtcgagttcctcacattgggggaaaatggcaggggtcagtacacccggaacataacggataagcctcgccctgagaaaaccaccttcgtgatcatggtatctcccccgccaagtaagtatgagcttttgcacctccgccccgccacagcctcacacgcttcaccctttacacgcacggtcacttgccccgcgcacgccccccccccccaccccccccgcccccagccctcctagccctgacacatagctgggactctcaggtccgaccagcggtcctgaacccgctcccacggcacgggaactccttagtggcgaagcagcagcccctgcgctgcctcatctacatagaaatcgccctatccgtgatgtcaccgacagcgcctttcccagacaccgtctgctcttccgccccaccctccgccgactcagccgatcaacccgctgccggagctggcggaggaagtgacgtctgtctctttctccttttcctcctgccattgtcctttggggaggtgcgcagagatcccacgtctggtctccccctaagactgtggtacttgatctgtgtcctgcagagaacccttctggcggccaacaggaagcttgtgcacccttcttcagataatgtcttttaatgcgcagacttgaacgtttaggattacaaggaaaaccggttcctttcaaacctgtttatctttgtgatgtagcattccgtttcaagttgaaagccattcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatgttagtattttatattctccaaagacacaaagataatcccaatttgacaaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattcctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcccaactgacattacaacagcgatctcaagactttttgtagcaataagacaccaaactccaggctgactctagtgtagcattacatgacagatagcaggccctgaaagaaatgaaaatattttaccctaaaatacattttttatcatattttgaaatgtccctacaaagttgtctcttgtggggaaagtctacatgctatagggaatccctttccaggccttttccctaatctaggcacctttttaagtctgataagaaacatttacaatcaattctctctgaagcctgctacctggaggcttcatctgcataataagaacaaccccttaacacagagactgccttctatggattccaggtctttagataaactctttcaaccaattgccagtcaaagtatcagaaaataacggctggtaactatgtaattatgcatatatatgagtagaattttgggggtggacacagtggctcatgcctgtaatcccagcactccctcaggaggctggcagattgcctgagtccaggagtttgagaccagcctgggaaacatggtgaaaccccatctctacaaaaaaaaaaaaaaaaaaaaaaaattagccaggcatggtggtgagcacctgtggtcccagctactcaggaggctgaggtgggagggttacttgagcctgggaggtgaaggttgcagtgacccaagcttgcaacactgcacttcagcctggatgacagaggaatggaccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcattcagtcttggctctggtgggaaacaaggggcacactcggatgtgtgatttaaagagagttgtgttttttttttgtttttttttttgagacggagtctcgctctgccgcccaggatggagtgcagtggtgccatctcggctcactgcaagctccgcctcccgggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctgggattacaggcgtgagccaccgcgcccggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagttctgtccagtgatcctccccaagacaaccgttctctctagtaactatggttttcctttctcatttcaattgccacctcaattgactgaaatgtgaacaccaactcccgcacttaaacgttgaagccctaacacctactgtgatgatttatgcagctggggcctttgagaggtaatcaggattaaaagaggttatgagagtggtgtcctcatgctgagattaatgccattacaagaagacagacactagaaagcttgcttgtccgccttccccctggtgcacgaagaaatggtcacatgggcacacagtgaatctacagccacttacaggccataggaagagaccttagaaagaaatccgctttgctaccacctttatcttggacttcccaacttccagaagtgtgagaaatacatttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtgcccttgggtataaatccaacttcttcattttaatggtgagaaaccaaaagcccacgtttcctgatttctggcccagcactggaactgttttcatggcacgtcaattcatcatacattttaatagtgatattttatatttgcataattttattgcctttgcaatgggctttcacatctatcttctcatgtgtatatagtttagaggccatttttacccactatttcctaatcatatcgaccacagcctcaggaaatgtctgctctattatttcacttgcctgtctgggttcttgggcaacagcatagaatcctgcactgtgttttccctcacgctttctcactctttgcagaacaaatttttgttacatgccttattatcatggtaatattggccttcagtcctgtatagaagcattaaaaatgtgcgtaatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacgttgtctttctgtagtgctctagcattttctaagcattttcacacactgttatctctttttttctttctccttctagaaattaattatgacttttcctttcaaaaatgaaggacttttttttttttttactcttttcattttttcctgagaccatatgtcaaagggaatgtgagtaacaactttggtgtggtaatagccaaattcctccaggtctgctcctcaagcttgcaaagtcaagactggcagaagtggtgatttttacctgggtatcctgagaaccttgcacagtccttatcacatgcaggtgttcagagtgtgcaaataaacgaagaaatgtgagattgtgatgatattttcatggcatgctttttttccacacttcctcatgcagcccaacatcctctacaatgtgttgttctacccgtttaagtgatttaccacttctccattaagccaacttaaaccatgttgccttcaactcaacattgattgatcccctatacagtcctgtagggaggcaagaaaacttacaaacgaagtggtaaagaaagagagagattaagcaatttgccccaaatctcataaccactaggtgataaatcttcaactagaactcaaatatctgactgagaattcagtgcttttttcatttaaatcacattgcttcataaaaatagatctgcaggaagaataaaaatgtccaaagtgcaatgagacagagaagataatatggagacagacatattgcacagaaagcatttgaccatatgtctgcctgatctccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatggctttaatctcttatttattttgactgttgagattttgtagccattatccaaataaaacatttattttcactcgtgagtccctaatccttcgtcaatggaattagctatttatttgatgcaatagctagaccagtagggttaaaaatgcttttataaagacattaatagctgggtatggtgatgtgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaacggaaactagaaatcattgccatcagctttctctaatgtgtacttgatccttttctccctgtgatggaagtcgaaagtctttttgtttttttcttaatccactactgttcaaatgagaataaacagccaaatgactgaattagttggtagacataattcctagtcttcaattatttttatattcttttgtaatacagtcattattttttcagacttctataatattgcatttaaccaatccccaaatagggaaacgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctacccagatagagagaagtcaggcagggctgtgctgtgaaaatattagagaagcttgatgggaggcctaatatagtttgtctttacacctgtatattttgcttcttgcatctgcttcaatgccctctgtcatttattataactagatatattgttctaatagatttgtactacagtcagagcaaacaaatcactggatccagcagaagccttagatatatgacataacagagatttgcacaaagatttgccccattgccttctcaaatttctcttatcatcaatccatctagctggagctctctgaaggtcatcagaggtcagtataattttaataagattttaactgaaggctagccttgatgttcagtgaccttcagacatgtttataatcgagaagccactccccctgttgaatgataacctcttccatgaattaccaaaccaatggtgctcacattctgattaacgattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttagcatttgtcacgttagtatacagcttctctaactgtcatgaaatgaaataaatgggaagaagatgaaacatgaaaagaaatctgcttcttaaggcaggccctgggggaatagccctggctggaggtaatgtaaggtctagatggtgtttttagaatctgaagactgcaacaccaaacacaacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaatggctaagaaatagtaaaattaacacatggcctaaaatattaagaaattatgcctgttacagaattacggacctggctagtatataggagcattaacaacacaaaaacagattaggtcgggattagcagtgggggtgaaataatcttcagggctgaactactgagctagaaatatttaaatcctccttgcagatgaaaactatagaggacaatttattggttcagcatgaatttctggtcttctgttaagaaatacgctctttcattgaaagtgaacattgaggcagtaaactccaaatacagctgcaggtactatctcctgctgatttgtgtgtatagagcatgaaagaaaggctcagaaacaaaagcatgttggaaaaataagcagaaggagacatttacttgcaaagaaatgtgaggaagtcattcttcaaaagaactgcccaaaaaattaaaaaaatagaactttttaagacaaacaatattatgaagacaatagggcttatattaatctcttcatggcagaaaactgcaattttatcatggttattgtattcagaaagttcatgacatatcttcagacaataaacagcattgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaacgggccgacaatggtgtcaggccccgatgtcactttggtttttacacttcatcttgcggtcatgtttccttctctacaggacatgtttgtctacctccatttgctgaacaatgttcctaatcagtactattgattttacattttaatttgatccattttatttgcacagatctaagaagtgttgattaatatttaatgacctcctagtatttttttgatgaaacaataaactaaggctcacaagtttacgtctatctatagatttataaagcccttgtgctttaaatttacttttacatgtttaacagctcagtttagagcagaccaaaccagtccgttcacctctacctgatttcatctgcagtatttataatgcaaatgtatcctttttaataaaagttatccaatgtctcggtgtccctgctctgccaagaaaggacattctttcttacctccaagcctgagattgcatagtccatagagcaagcaccagattggtttcctagaaggatgttataggcatcgcttctgcatgaaaaacatagaaattattcttattactggatttgtcttgtctaattaaattgaatttgtagcacagctataaattttttattaaaaaattgattcttcctggctgggcaaggtggctgatgcctgtaatcccagcattttgaaaggctgaggccggcagatcacctgaggtcaggagtttaagaccagccaggccaacatggtgaaaccccgtctctataaaaacacaaatagtagcctagcatgatggtgggtgcctgtaatcccagctacctgggaggctgaggtgggagaagtgtttgagcccaagattgagaggttgcagtgagttgagatcacgccattgcactccagcctgggcaacagagcaagactccatctcaaaaaaaaaaaaaaaaaaaaaaatttctaatcagtaatatattcaggtagaagggaggacaaattcttattgaaccaatacaaataactacatagtcacataaagtaaatgtttttattaaagaaactttgtgcaagatttaagcaatattgctaattaagtgtatgttaatagacaaaaccaaatattgtatgtcacaattctttacaaaataattatttgtatgtttttcttggcaacttattagctttgtttttatattaagaatttctgcaaggtatttttttcctcaacactaagaattcagagtgttttatttagtttttacaaatttaataatttgtacatttaattggagattaaaggtagattaagaagaaagaaaatgggtttctctcatgttcattaaagtagaaaattaaactagcctcaattaaattgccttactgaggccctttaatcctaaataacaacctcttgtcgtgctggtcttgagttaagcagtctactttcatgaattcatcggcttctacactgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatacttcttccagatgactcaaattctgattggcgctttgtagagaggcttttaggtatgcttaaagggaaaggagggctgggcacagtggctcatgtctgtaatcccaacactttaggaggctgaggcaggcagatcacttgaggtccggagtttgagaccagcctggccaacatggtgaaaccctgtgtctactgaaaatagaaaaattagccatgcatggtggcgggcacctgaatatagctactcgggaggctgaggtaggaggacagcttgaacctgagaggtagagtttgcagtgagctgaggtcataccactgcactccagcctgggcaacagagcgagattccatctaaaaaaaaaaaaaaaaagcagcggggatagggggaggagatgttgctaataataaaactgtaaagtttggttaattttttgccatagcaaacaacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattataacatagccacagtaatcatacataattattgcatttaattaatttaagatgattttattgctattttctcagaatatggccttgaaaaacacagcagcttccactatattgagcatagttttgagcaaattaaacatctggagaatgcaaaacattacctttatttctaatatatcttcatgttaagagctaggaggaggatctctggagtttcccagcagccatctgagaaacccagagatactgtattcataagtaacatctcagtagttttactattttggatttgagggttaaatttggggaatatggtatcaaaaacagtgtcacaggtgggggctgcagatgtgaagggcctgctatcaatcaggtgaccctggatggactacccactccctgtgtcagtccaggatcccagctgtagtgggttcctctctgctacagcacatgtttctaaagggcaagaatctgggctcccaataactgacctctgtctcctccatcctggcttgtcatggtagacccgaaccaccctcccattgaatttgggcccttgtggctcatagccacaagggaaattgggagctcacatgtgaaaggcagaattaagttaatgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggaacaagaaagacaacatgacttctggaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctgtattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgttgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcacctgtaatcccagctactcaggaggctgaggcaggagaatcactggaacccaggaggcagaggctgcagtgagccaagatggcgccattgccctccagcctgagggacaagagcaagactttgtctcaaaaaaaaaaaaaaggttaatatatggagattgatttatcattttatcaaaaaggtaacccaaatactaatatgacttttttgagaccatccatttaacaaattggactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagactcatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccatgtagggtatgtgtggttttacctatacagtataattatttgtagccccatctcaagttacaggaacaaatgttttaaaaaatactagtttaataattcaattcagctgagccataaatccagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttaaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaattcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctatcaacagttagagctctccatttttcaagctatgcaagattgtctccaatagttatggcttcagcagtggttcagcttgagtgtgcatcagaaccacctgcaaagcctaattaaacggattccttggctcacttggcagtatatgactcagtaggtaagatttgagaatttgcatatctaacaagttgtcgggtaatactgataccgatgtctagggactatgagaatcactaacctagagtgtttaaaaaatgaccaatttctgtgcccaattatctgccaaagtttcctaagagaaggaaaacaacaacaacaaacaaacaaacaaaccaaaacagagagaaactgagagaaacagccacaactggaaactagtaacacaaaaacaaaccattgtaaaggctaattaacttattttcataccaatggggaaagatttttatttcattttgcacccacaaaaagctttaggagttttttcatgtgccagaaggaagcacataacctccaaattcacaatctattctttgcccgtttgctgtagttactctttgtaccaaaggttctgagtctggagtctctgcttccactggtcagatagactctctccttacattgtggtctctcactgaatgttctcacccactgcttcctcactacgtaatatctgcccaagaagctcccgtcttctcattctcccatcccatatgctgacattctttccagtccctgcattgttatgagagctcagtgggtgagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatacaaggtaagatcaacatttgaagtgattgagtttaaacataaaaagatgtattggctcctgcgactgggcagtcttcagggttagttgcttgagtgatcaacgataccattaagattatgattgggacatgaaaaaaagaactggcaaataaggagagaactttgacaatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactgagaataatcatcacaccattctgtctcacattctagaaggctttgtagtggtagaactgtaaacaacatataaacatttctgaaatattgtggttgttttatcttccataaacctcacacaagccgtgtgtatgatcatccatcttctgggccattatctgattattgctgctatctctcgctttggggaaaggaggtctctttccttatcaatactattggatcagctcttctaatttcatgatgacatgagtgttcaggaatgatggaaggcaaatgtaactctgagaaaacttggtttaactactgcatttcacaagtccatatccatcctagaaggtcttccagcctgctctctgccttgctcccaagatggccacatgtaggtctcttctttcccgtaaccagagggttatagattatattatccttcaaagtctgggataaaccaatttctcactctaaagagaacaacgtgttttgatttttccaaccctaaccctagcctaaagtctaccttctaatcctatcttattacaaatgtccctggattgatctttcaagggatttttgcctactgaaaaaatattactctcactcaaagaattgtggcctgacaagaaatctacaagagtcttggacacagaggccaaaacatcataacatctggattattcaggataaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatttctacttccttgaaattttattgagaaatccatcattttccaaacttttctttctattggtgtaaaacagggatgaatggccatgagcacttcattgcctcatctcaggtgacacttctttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatggtttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaggaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaaaaatatatcagaaaaagttttggagaattgcaattgaaaaaactagcagactaactgcatagcctagaatataaaaaaaaaaaattaagaaaaagctatgtacatcctgaatgcataaagtatatgtatatattaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaacaatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatcttttggaatattctccagcgtctactttccagtgtatgtactattataataattttgtagccaccccctgttgctactgtggtgagctcatgttgccagtatctgccatgagcacttggtctcttcagtaaattctgtatctacgtaaatagtgtgttctctcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaagatcccttaaaaaaaaaaagagaaattcataaggcctcattttgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcctggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacctcagcctctagataagggagtcataaggacctttaaggctctacatatggcactctatggaaaggtttgtcaacattgcaaaagagaaacccaatagagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaacagcagtgccagaaaacaaattggcattcaacaatctggcaaaagaactttgattattcaagactacttttgacttcttttatgacatagaccgttccatgatacaggaactgaaactgaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaacacaacaatgatgaagacctttaggatgatccacctccacttaatgaatgggtcatatattttctcttccttacaattttcttgactataatttcttttctgtagcttagtttattgtaagaatacagtatataatacacatagcatgcaaaatatgtcttaaatgtaacgcatgttatcagtaagccttctggtcaacaataggttattagtagtttggggggaatcaaaatttgtatgcagatttttcactgtgtgggaggccagctcccctaaccctatattgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcatccctgaatccttatcagcaatgaatttttaaatatactataagagatgaaaaaatttttttaaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttaaagaaaagagtctataagacaaaggtcctcataaattaagagaagccaagacagtcactgtgactgcagaatattttaatttttttttattatactttaagttctagggtacatgtgaacaacgtgcaggtttgttacatatgtatacatgtgccatgttggtgtgctgcacccattaactcatcttttacattaggtatatctcttaatgctatccctcccccagccccccaccacagagcaggccccagtgtgtgatgttccctttcctgtatccatgtgttctcattgttcaattcccacctgtgagtgagaacatgcggtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctatcactgatggacatttgggttggttccaagtctttgctattgtgaatagtgccgcaataaacatacgtgtgcgtgtgtctttatagcagcatgatttataatcctttgggtatatacccagtaatgggatggctatgtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgacggccagtgatgattgatgatgagcattttttcatgtgtctgttggctgcataaatgtcttcttttgagaagtgtctgttcatatacttcacccacttgttgttggggttgtttgttttttcttgtaaatttgtttgagttcattgtagattctggatattagccctttgtcagatgagtagattgcaaaaatgttctcccattctgtaggctgcctgttcatgctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtataaggtgtaaggaagggacccagtttcagctttctacatatggctagccagttttcccagcaccatttattaaacagggaatcctttccccatttcttgcttttgtcaggtttgtcaaagatcagatggttgtagatgtgtggtgttatttctgagggctctgttctgttccattggtctatatctctgttttggtacaagtaccatgctgttttggttattgtagcctcatagtctagtttgaagtcaggtagcgtgatgcctccagctttgttctttttgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcatttttaaatcctttcagcacagagacaatcaactgactgtctgggtactacctgaccactattggagtctctttcatctgcctgagtctgtgcaacaatatgaaaattaattttactatgcacgtaaacgttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacggtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtcttccaatgtgttttcatacattttctttctgggatcttgagtgaaacatgtggatttagaacaagaacaaaatgatgttaccttgatgatctctatgtagggtcacactcaaggcatcttaaaatattttgctggccaacaaaagacacctcctgttctaattgggcattgaccttttctttaaactatgcagacaaacaatattataaagtgagaacatctgcataaaaaacctaaacataaatcttaatagtgagttcatgaaaattcttactgatgaaatggcaatgtcacagactgactgtttatgtccccccaaatttgtatattgaaatcctaacccccaagctactcgtgttaggagacagagccttggggaagtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccgtttactcactgttcctctttattttagtttcacatttttgctatttatctctgtaattttattcattcttcacaatttgccattcttatacttcgaatcatgttatcagtttataatacctccatcaaatgatagtctgcatttgtttatccttggctgattcaaaacacttggcataatttccttaaaggaaatcatcttcatcccacctcacaacactgtattattttcaattaatttccaataaactcttaattgtccatgctctgtcagagttggcagagttaatccctgtttaagctaataggttcaacttcttcaacaaacaaatctttcatgaaagctgctgacaagccagagtattaattaaatctagtttcattgcttctcactttccttgatccttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcgagtacagtatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttattcatttaaacagcaaggtacatttcattctacagatatactatataatatttactccgatctctggatgagaatttatgttgcctgtaaatattgtatcacaaacattataagaataatctctctaaaggttttcttcctgaattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacaaataatgcaatattatacaagggagattaataggtagaaaaagaaatgcaatggccaggagtaacagaagatgttcaacatcaatccaatcaaattaatgcgtctttaaaatgcaatagcagtcaatgttagcaagagtgtaggtattagacattctcataggaatataaactaaggccatgttttaggatcatattagatcgcagcaattaaaaaatgttaaattcatatgttgtatagcaacttctcaggttggaatttatcacatggagaatcttgtaaaatacataaaccaagatatgttattaatgttattggtagcctattgttttaataaaaaatatatttatacaatacagttgttaaaagttaagaatatcttgaaggtaaattattaaacaaaaatagaaagcctaggccaggcaagacttcatctcatgcttataatcccaacacttttggagactgaggcgggaggattgcttgagcccaggagtttgagaccaacctgggcaacacagtgagacctcatctctagaaaaaaaaaatacaaagcctagttctgaacatccttttgtgtaatactaaaagataaaattttattttctatcttgtttaagatctatattctatacgggggttgtgtattaaggtcatttttaaaaagatactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaatggtatacattttttgattcaagctaatttcatgttacgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccatggttattaatcagtctcactgactacattttccgttttacatcccctttcaggcactactgcagatggccaagcatatcacattatgtaaataaaataaaacaaaatcttttcccattgagcaaatggatatacttcacctctaatgcttccagtctttctcagatcattcaaaaagcatgatatggtttccatgaaaggacattcatcccatttgactaactggaatttctttactccagctaatctttaccaaagagctgaattaattcaagttgacaccctgttatctaccagctcttccagcccttttgcttgattgttttgtcattttgccttttcttttcttctaaagtgggagtatggagatttacccttctgaaacagctgtgtcacatcatgatccttgagaatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggggcccagtgggagataactgaatcatgaggatgggtctttcctgtgctgttcttgggttagtgagtaagtctcatgagatctgatcatttttaaaatgggagtttccctgcacaagctgtctctttgcctgctgccatccatgtaagatgtgacttgctcctctttgtcctccaccatgattgtgaggcctccccacccatgtggaactgtaagtccattaaacctctttcttttgtaaattgcccggtctcaggtatgtctttatcagcagcatgaaaacagatgaatacaacaatactgtaacaaatcgactcacatctgttctctttataggaattgcagtgctacaatattagtggctcttaattctaagagtgttaaaaaatattaatgcttctctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggacagagaggctgcattaagctatgatcacatcactgcactctagcctgggtgacaaagtgagatcatgtcaaaaaaaaaaagaaaaagaaaggagaaagaaaggaagaagaggaaggaaggaaggaaggaaggaaggaaaagaagaaagaaagaagaaagaaaggaacaaagaaagaaagaaagaagagaaaaagagagagaggaagaaagaaagagagaaagaaagaaaagaaaaaggaaggaaagaaaggaagaaagaaagaaaaagagagaaagaagaaagaagaaaaggaaagaaagaaagagagagagaaagaaggaaaagaacgaaaattcaagtcctgccttgtaaaatgcagtactccattttcccaaagagatcccaagggaaacttaactacaggataaagacagacaaaaggacataaattacaactactctaggttcacatattattttgtttctgaaatgggttttaaaatatctatgtcagagttcatttctagaactttatctctagaaaacatattttcacttctcaatacaggaaaatggagattggaaaaatgagtttggaaaatgatttccatgcttatctctcagcttcttttttcaacttccctttttcatctccgtatcttcactgatacctaggaatctctgttacatcacagtcttcaagagctttgctcacagcgaattagttaagacattagctttcaaaagtatatgatattctctcacaagcatttgtctacttttaatagggcaagctacgtaaagatgttaaatctcattccagaaataccacatctattctacctatttatgagaacagtcgtctctagaccaagatagaaattcatagttaggaaataaatccctgtagggtttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaatgttattttactgaattactcattgctgttttctcattttttaaataataaacacttattaagaaacattggaaatataccaaaaatagtaaacaataaaacagaaaccattggcagaaatagtcactattaaaatcttaatatactcccttccaatgttgtttctgttaatgcaaattaaaaaatcagagattcgcctctgtgaactagatctctttttacctttagatattatttgacaaatacatagctcaatcatctatccaaacttctcttttacagactccatgccaattaaccttctcctatgaaactattatttcttcacataggataaatatggttattgacacacaaactttcttagttacactgcaatccagttgtgcgttcctaaatttataccaattggatttagaatgatcattactaaagaggcttggccttatctcttgcaatttgcttcttccttcttaaattcaattcttgtaatgtaactataatttgggggtatctttttgcctcatattcaaattctctttcaaactgaggtacatttctgtatttctgtatttgtatattgcatataatagtatagaaaacaataatgagattatagtgtacataaaagttttgaagtataattaaatatttaatatataaatatattaaatatgggctgctgactcaccaagcctggtttggcttccatcacttgtgtaatcaatcacctgtattaaatcacctctgcttgaaagatgaagaatagtttctgatttataagcaaacactgaaagctcttctatttcttgtttgctaaacaagatttgtcaaagttaaatattttattttattgaattcactttttgcctctcctacaatgatgatttgcttttcctcctttaacttgttaatgtgatgaattatacatagtttttttttctattgttagaaatccttgcattcatggaacaaacacaattttcatactatattttttatagacttctaaacttaatttgctaacttttaatttaaaatgtttgccgttaggttcatgaggaaagttggcatgtaattttcctgtcttacgcatttctcatataacattggtatcaaggttgtactggcctcataaaatgaacgaacaaatggacctttttttattctggagttgtttttataaaatggaaataatccatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgacgaaaagccctcagatattaaatataaccttaaatataaccttcccccaattcaatttttcttttgcagatatgattagatactctaatttttcaacctctatttcacatatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaaattcagtttcaatctgcttaatataagatacatacactgtctcaatttatattcctggcacacctcattgattttttaaacatattaaacacagcttttatagttatataatcgtcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggttttttttaacttatacttacagtgaaaatttaaaccacaaattcatgtgaagatggccttctcatttttcctctaaatagcaccgagtttgaggcaggaaaatttcctggttgtctccccctgaggaacaggtttttatctagtttatcctttcactgaaattatagtccttcgtatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttagtttctattcaagtcagtaatatacttttgaaaaatgacatgtacattttatctggtatttgtagatttcatatagcaggatagtgattcagcaaatttagtctaccacaatgctgggaatagaattcccctaatttttgaaaacattatattaaatcatgtttattgccattaatagtcttataaatgtgcttttaactaactgcattttgtcatagctcattgtgattgtatatttaactagttcacccctacctcatgttttttgggagtgaaggttgtactcaactcattatgttaagtaatactacagtaaacatcaatctatacatgcattaataatgatttccaagaaagtagtgacacatggtcataatcatctttgaggctggtggtacatattttcaaattgcatctcagaaataatataccaatctgtgctctaatcagccgcatatgaaagtgtcatctttctgttctccaaccaatacaactactactgtttttatacctgcaaatctgacaaagatgtgagaaggcatcttatagtttcaatttgtatttctttggtgaccaatgtactaaattactcaatgtactaaattactcttttcctgtttatgatccatttcaaacaaaatgtaaaccattttttaaatttttttatattaatgcaaatcgtaaatcactactttatttattcaacttcctaagcaaaattatatgttgtcccatttatacattttatattagatctttctgccttacatttataacctaaaaactgtcagaactatataataatgatgaacagttgattataaataatgtctttattaggatatttctccataaatctaaatttcatcaatctttctttaaatatctctacacaatgtcctcttgtattatattaataattgcagatacacttctttttgctatttctattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcgatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataatgataccaattcaagaaggagaaaattgatgtactgataaacaaatgggcatcttaggatcatgtttctcacaagtaaggcagttccagaaattcctaggaccataatgggttttattctaaataggttaaacatatcacttaaaaaattgttttctacagttctctaatattgcttacaattgtccacgtttccatgtttataaacttgcacttttttttttttttatggagttttgctgttgttgcccaggctggagcccaggctggagtgtagtggcgtgatcttggctcactgcaacctccacctcccaggttcaagcaattcttctgcctcagccttctgagtagctgggattacaggtgcgtgccaccacacctggctaattttttgtagttttagtagagacggggtttcaccatgttggccaggctggtctcgaactcctgacctcaggtgatccacccgccttggcctcccaaagtgctgggattacaggcatgagccactgctcccggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcctctatctgcctcatgtaaggtgcaggtgacataattaggtaatcaagcaaaagatcacatattttaataagaaagagacactggctattattttgagtggcaaaacaggttattcagtcccagtttaaaatggaaatgacagagaccaagatgaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacgccagctaacaaaacatgctatccaggctctttcgtttcaccatattgctttcttgaaaacataggacagtgccagtttagcactgaaaaaaatcagttctcctaattctaaaaagaggagacagccaggcgtggtgggtcactaaaaatacaaaaaattagctgggcatggtggtgcatgcctgtaatcccagctacttgggaggctgaggcaaaagaatcacttaaacccgggaggtgaaggttgcagtgtgctgagatagcgccattgcactctcgcctgggcaacaagagcgaaactccgtctcaagaaaaaaaaaaaaaaagagagagagagagagaaactgtaatttcatttcagaagttttatagggtactatttccaattctttttttcttactccattaaagtgtaattagcagtatgtgaaaatttccactttatcctcaatcagaagcctctccttccaattagcatatattttttctattaactttgtaaagtgggattcttgttttatacatacccctggaaagtatacttaaactgtgagaccctgggattttatatttccaaatagaagataccatcctcttgtatcacaaaatgtacctaagatggtttggattatatttaaatattcttgaatgaaatagacttactgactgaagccaattattatatttttccacaccaaaataaatgcaataggaaaagatgacagttctatgtagtattcctgcttccatattgcacaaattagaaacatacatattccattatgttacagggtctagggctttgggaggacaaggctgcaggcagccgagattgtgccgctgcactccagcctgggcgacagagtgagatcttttctcaataataataataaaagtaaaaagaaatataatatttaatcaatatatgcacacacatgggtttatcatgacacacacgacatgtgtgtacagtgaaaaaaatgagtaaatctagaaacctgtattgcctcaatagctagctaagtacttcaatatgcatgtttatttcaacaattttgtgttaagcttcagtggtaaataagcagagtacactgaccataatgaatacttcttttgatgagggttatcactacacaattaaaatattacatagttggctgggcacgttggctcacacctataatcccagcactttgggaggccgaggcaggcagatcacctgaggatgggagttcaataccagcctgactaacatggagaaaccccttctctattaaaaatacaaaattaaccaggcgtggtggcacatgcctgtaatcccagctactcaggacgctgaggcaggagaatcacttgaacctgggaggcagaggttgtggtgagccgagatagcgccattgcactccagcctgggcaacaaaagcaaaactccgtctcaaaaaaatatataataataaatatatatatattatatataatcaatataatataatatataataaatatataatatgtattatacaaataataaatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgtttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctgataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaattttttttatttttatttttttagtttttttaagagacagagtctcgcagtgttgccaaggctggatgcagtcacgccaactcagctcactgcaaccttcgccttcagggttcaagcgattctgctgcctcagcctcccaagtagctgggactgcagaagggcaccacgatgccccactaatttttgtatttttagtagagatgtggtttcaccatattggccaggctggtcttgaactcctgatctcatgatccgcccacctcagcttccctaagtgctgggattacaggcgtgagccaccgcgtctggctgcatgaccttttaacttgtctcatacactcaatattctcaagatataccttccaaagtgcaaaattatggcactttgcagccctgaccactaactgagaactttgatgctttggattttggagacctcattttatcacctggtccttttacttcatgacttgtcatgctgccaccttttgatgggattgagatgaagataataattcccaactggtcaggaatattgtgcccctttgtttttatatccagatgcaatagagcctctgacacaccactactattgttcttaggatttggaacaaaatgcatctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcagcagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggctcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagataattagggactcggaaagacaaagactgaaggattggtggcaatgagttttggggaaaaaatatgtagatgaaccacagaaaatgagccagagtgtaagaatatttgtgcttaatacgaatgctcacgaaactatcatcaggaaggttatcaaatagatatgaaggtatgaaacaatctctttcaccaggcactacattgcttgcttagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttattggagctcctctatgataaaggcaacaaggaattttgtaaatggaatctacctttaaccttgaattacatttgctttacctgacatcatttttctctgatcgccactctccacgggtacattgaatgccttatatatactgccataatatcctgttctacatccttctcttaaaagaacttgttgtataacaaatgagtagatattcattggactcacctggtccaccatttatcctatcactaaccaaaattattattattacagaatggtgaatattttattaaagactcaatcacagtgtcagctggagacaatggcttataaggttgtactcatgctagaggatgtggtggtgtatcctctgaactagtaactaagtataagcttgtctggtgtctcctatataaaaaatacaacaatctttgatatttgttatgaatgttgaagtgactccttttgtcattacatctaatgatccactccaaatacttgtctcttgtctctgagattctaggtttttgcagaattagtaaccaaagggagagtcttagcagtattccattttacaatccatccttcgttagaggatgagagacttctatctagccttttaggttgcctgagacctttaaacaaacagtcaaaaatttaaaatttaaaatgcggctacactgtggcatggggtagtaaatcttgaccttaaaactggtatttgtaagaaaaacagaaagaattcagggatcccctttgatggctcctaattctatacagtcctgtaaatattcctgaagactaaccaggcatggtggtgcacacctgtaatcccagctactccagaggctgaggaagagaatcacttgaacctgggaggcggaggttgcaatgagctgagattgtgccacttcactccagcctgggtgacagagcaagactctgtctcaaaaaaaacaaaaaaaagaagaagaaagaaagaaagaaagaaagaaagaaagaaagaaagaaagaaagaaagaaagaaagaaagaaatgaagactgccacaacttggaagcaaccaagatgtccttcaataggtgactgcataagcaaactgtggtatattcctacagtggaatattattcagtgctaaaaggaaaaaactatcaagccacaaaaagatacagaaaaacaaagacattttgctaagtgaaagaagccagtctgaaaagggtacatactgtgatttcaactatacaacactctggaaaaggccaaactataaagacagtgaaaagatcagtggttatctttgcagacgccaccatcgctgtgagccctgtactatcagccatggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcgtttggcaaggtgaaagaacgtgtgaatattgtggaagccacggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggatggcagagttgagttaagtttatgattatgaaataaaaactaagtaacaacaacaacaacaaaaaagctcagtggttgccaggagtttggggatgggtagggagataaacagttctgaaacaggcgatttttaggggattgaaaatacgttggtaataatgtaatgatgggtacatgacattatgcgttttgcaaaactcctagacctgtaccacacaaagagtgaactctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatttcacaaggcaaaaccctgactagcagaggtgttagctgagggcacatggccatagatgccaatagtgacctgctggccacttgcagaaaggagagcctttacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaactttgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaatatttactatttgatgtttgttcctgtgtttgaggaattcctcagcctctcagttttgacgaaaacaagaaaccacctcctgctttagaagctaaaatgtcaaatgcttgctttctcagcctcctttgcagctatctgttgcaaagcgaacaagtgggagtggtgctggtggctttgcagttagcctaggattgagcaattgctgcaattgttgctctctgcatcttcggtgttacttcttactggtggtgacagtggtttcctccctggatgagttctacagcatggtttggggtacatttcctggctgcctagctttgatctggctctctagccttctcaacagttctacaagttccccactatttctgtgataaacctatttattgttaatgtcagccataattggcttctgtggtttatattttttaaaattccaagatataccaatgtaacagatagctcaacaaacatatgtctttttaaattaagatatattctgtgtcacatgaagtacaatggacaaaatgcaacaaattgaattgagctaaagaccaaatatatattaagcctggctggtcttaaaaatgtaactggatacagccaggcatggtggctcacgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagtgagactttgtttcaaaataaaaaaataaaaataaaaaaataaaaatgtaactggatagacctaaggatcttgaataagcagaaaataatttaggtaaaaaccaaataataaactaacattctgaaaggtttaggatttggaggcccaaatgtcttagctaaaagtgttcattctaacctcacaggaaaattgaaatatgaaaatatacagaaaaatcttaggcagtatttatcaattttaagaaacaactatttacaggtttttcaataggcattacattaaaaacaaaatatatacttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagtttttttcatttggaacacacactcattccccagtatactaggggtaataataatttaaagagtttaattactttttactactagaaaactaattttatgtttggcacaaatttctgaaatgatattccactgcaaagaataatacctatatatggccagaattacttttcttctataacattaagataatacttgtcagcctgagcaacaaagtgagacctcatctttacaaaaaataaataaattagacgggtgttgtggtgatgagggtctgtagtcccagatactcaagaggctgaggtgggaggatctcttgagcctaggaggtcgcggttgcagtgaactatgattgcaccactgcactccagcctgggtaacagagcaagatcctctctcaaaataaaaataataaaaaaaaagataatattggtataattcagggtttttgcctcaatccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattaccccaaaaatatgacctgctgaatttctgctgtcatgaattgactaacatattttgtgcctaaaacctttacatttagaatctttttgtttcgtattggaaaatattgtaagtcctccatttattggtcaaaagcactgcctatttatttccatgcttaatcagagagactttccaatagttatttaatattatttacgttcattcacttgttgactataatgaggttagttgctatgatatctttaggtcattaatataataaaaatatgtcaacttttctcttccaatgtgtctttgggttattaatttttaactcaggtatcaagcttgtaaaatgtttaatggcttataataatgtctaacacatagtatccactgagttctgataactctggtttatcaaattctctttttttgtaccattctccaaatgcaatgctatttggttttatttttattttttaaaaatgtgctgcctgttttgagtctctaaaagtgtgaaatgctcagcatttcccaaatgtatttgaacatggagtgttatatttactaaaaagttaacaagcaagtattcccctaaacactctagcaaatactactagtacagacaaattatgatgtaacattatagtacattttaacttattaggttaattttggttgcaaacaatcaaaattcaaaatggcttgtataataaagagattttgaacaatagtataggctcaagatagcctaatgcagaagtttaataatgacacaaaataaatgcttcttgtcctccctgtttcttcactctaccttaagtgatatagattgaatgtttgtatcccccccaaaatttgtatgtttaaatctaatccctagtgtgatgatatttggcagtgggtcttcggggggtgattaggtcatgaggacagagccctcatgaatgggattagtgcccttataaaagagaccttagagaacttccttgccccttccaccatgtgaggacacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaacacattaggtctcagttttattctatggcttaaaatatcatgtcatgagtagacaacttccaatcctagtacctcctgcttcctctgctgcatttggaaagaaggcatttccctcttcaatcatggaatgaaaaagttgtacttcattctgatttgattagcagaaggcacacgttccttccatgcaccaattacaatgaccaagaattgggcatgggactcatgtcacttaaacattgtgaagctgagaaattcattatttggttaggagtgtgtgagagcagggaacactgaatgcttgagacaccaccacgatgtccactacatgtatttccatttcagtaaacatttccattaagataatgctagaacaaaatcagaggagtagatcttggtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacacctctacatatattttggaggcctttacacaaaagtgttttccctgaagggagaagagaaaagttgaatgcagaagtagaaaaaaaaattcatttgcacttgtagtatttatatctaaatattttatattacagatgtattaaaatttttataattttaaacactactttaaaacagggagatggtttaccttcaaaaaatttggctctcaactcaaagttatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcaaaagaaaaatagctggttttaaggaatgaagggccatgtcaactattggaagcatctttgaactggagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaacttaatttttttaagaagaagcatttgatctgccaaagagaagagttagcagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataacttcttgtccattcttgtatgtgttatggtttctttcttagaaagaagtatgctatactagtatacatactatttattcatgaaccttgcacttatcatgtaatcatatgtcttagtggtcttttcataatagatgtctctctttcccacgctgtcagtggtgattgcatgaggcattgtacagacgtaccaataattacttactctgtgtcatattgttggttattcagattgttttcactttgcccttgcagacaacactgcaatgaacatccttatgcatatattattccaaatacatcatcgtcatggctgtgtgagagaaatatacattgttgattttatttttttattttttataatttcaacttttgattttagatacagtgggtacatgtgcaggtttgttacatgggtatgttgtgtaatgctgaggtttgcggcatgattgatccgatcactcaggtactaggcatagtagttgtttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataatggcatcgagttgcatccatgttgctgtaaaggacatgattttattattttttatggctgcaaagtattccatgacatatatgtaccatattttctttatccaatccacagttgatgggcacctaggttgattccatgtcttagcgattgtgaattacactgctgattttaatagaaaccactaatttttatgccaaaaaaatcatcaatgtgcacatgctccaaggctgtgtgagcatagcccttttccttgggatgtcaacaacactgggttttatcaaaatataatttttgccaatttattagttaacaaatgctaactcagtgctatttggatttgaactaccactggtgctgagcaactttttacatagtcactggcaatttatttatctttctctgttgtttatctttttctgtgtaataattttccctatcttctactcttttaaacattaagttttcactgttttcttaataatttttaagtttaaaaagtgaccttttggctgggcgcagtggctcacgcctgtaatcccaacactttgggaggccaaggcgggtggatcacaaggtcaggagatcaagaccatcctgcccaacatggtgaaaccccgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactccgtctcaaaagaaaaagtgaccattttatctgctacatataattctaatgatatttctcaattcgtttatcttttaacaatggtaatatataatgtcttgctatttagaaagatttttaaaagtattttacataaagaaatttttattctttgccattaatatttgcaggtttggaattttcaggacctcctcaaaggccacctacaggaaatgctcttcaaagacatttcactttttccccacttgattgtggagcaaagactaacactggcaatgctttgaagtacttgagtcaaatgggtctctcatgtggtcattactatactcactctcaggctccaatgcaaattgtttccttacgccaactactcttgctttcctttaatagacctattcctcctgggctgtctgaaactaacatttaattgtaaataaagtcctgcaaatccttggtatctcaaagaaccctccttccatttagttttaggagaactctccttctaaaactctattcttctccctggagtccagatccccattccttgcaacaaatgaacgcttgatttgagcactgaagggagataattggaagtttgactttgtgttctaggttttccctgccaatatatgcagcgtctttaaaactaattgggctgaggcaggagaactgcttgaacccaggaggaggaggttgcagtgagccgaaattgcaccattgaactccagcctgggtgatagagcaaggctccatctcaaaaaaaaaaaaaaaaaaaaaaaaagaaacagcaaaaagaaactaattaggttcaagaagttcgaatgaattcaacttagacaagctcttaagcagacatgttggaagttccagaaaagacagtttgggaaaatattttattaaaaaaaaaaaaagactgccctccacttcctcactctttcttcccacttattttcactccactggtgcagtttggtgtcaactctccccactctactgaaactgctgcagccgaggttactagttatttaattaacaaaagcaatagattttgttttttttaattgcattatactctactattttgtgacatttaaactattgacaatgtctttcttgaaaatgtgtcctttttgttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatatgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataatcctcacagtaattttatgagataagttctatttattatccctatcttaaggatgaggaaactgtggtttaaagagcttaagtaatttgggcaaatcatgaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagtttttagtgcatagcatagggcttagaaaggagaaaatgatgaaaaatatttattaaaataattgtttttctttgatagttgttataaccatcgaattgtgagtgcttaacaattactataaaggagaatggaaatcacagatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggtgtgcaccaccatgcctggctaatttttgtatttttggtagagatggggtttcaccacattggccaggctggtctcaaactcctgacctccagtgatccacccatctcagactcccaaagagctgggattataggcttgaaccaccgtgctgggcctttcttagagaatttatagtttacctggaaatgtaaactatatatatacttaaactgagggatatttacaaaagagctttctacttaacccacaagaagctgtattaataacaaagcaaatcaagcttgttcacaggcaactgaatggaatgaatggttttgattggtgttgccagttatatttctaacaagagaaaattcaatgtgagcctcatttggaaacaagatattacagagaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaacatttaatccctggaaaaaatgatgacatcacactgaaatcttgactcataagagaacttttttatgctgttccctaagtcagtttatttctacttcattcttgcgttaagggtaggctcaattcttactcattcaaaaacggtatcacctgaagcttttctttaattcttgttttctctgcagtgagaaaattaatcaaggggttaaaatgtatattaaattatatatgtattatatgtaaaagttatataatatagatcagagaagaatatattgcatatgttataggctgaattgtgtcctttccccaaattaatatgctgtaccctgccccctgccatcccagtatatcagaaggtggctatatttggagatagagacttttaagaggtaactaatgtaaaatgaggtcacatgtctgggtcctaatccaatatcactggtgtccttatttgaagaggaaatttaggtacagacatacatgtgcacagaaaaaagtccatgagaagacaagatgagaaaatgactatctaaaagccaaggagagaaatttcagaataaaattaacacatctgatgccttgacctcacacttctagcctccagaaccgtgagaaaataaatttctgttgtttaactcacccagtctgcagtaattgttataacaaccctagcaaagtaatataggaagtatatatatatatatatatacacacatacatatatatatatacacatatttgtgtgtgtgtgtgtgtgtatatatatatatatatatatatatatatatatatgtgatagagtagatagatagagacatatacagtcatccctcagtattagtggggtattgcattcaggagccctgcatataaggaagtctgcacatactcaggtcccacagtcaaccttgcagagctcgcatatgaaaagttggccctccacatatgtgggtttcacgtcccacaaatactatattttcaatctgtatttggctgaaaaaatccacctataagtggactcacacagtttaaaccagtgttattcaaaggtcaactgttgatatatagatatataaatatctcatatgtatagagcaagcgagagaaaaaatctctaatctctcttccttcctgctctttttggattgcaaactcttctctcataagtacaaaaagtaatgttaacaaagtaaagagaattggaaatagtagtgtttttgaccactagtgttttgtaattttggaaaaaaaaattactgaaatgtaactttttatttatattgagatgttttgactcatactccaatcatacagaaataatagataaaatatgaaaaagacttctttttacatacatagctggattaaaatattagaaataattttcttccctcaaaggatcccctatttaataaacggtgctgggaaaactggctagccatatgtagaaagctgaaactggatccctttcttacaccatacacaaaaattaactcaagatggattaaagacttaaatgaaagacctaacaccataaaaaaccctagaagaaaacctaggcaataccattcaagacataggcacgggcaaagacttcacgaccagaacaccaaaagcaatggcaacaaaagctaaaatagacaaatgcgatctaattaaactaaagagcttctgcacagcaaaagaaactctcatcaaagtgaacaggcaatctaaaaaataggagaaaagttttgcaatatacccatctaaccaaggggtaatatccagaatctacaaagaacttcaacaaatttacaagaaaaaagcaaccccatcaaaaagtgggcaaagaatatgaacagacacttctcaaaagaagacatttatgcagccaacagacacataaaaaatgctcatcatctctggtcatcagagaaatgcatatcaaaaccacaatgagataccatcacatgccagttagaatgatgatcattaaaaagtcaggaaacaacagatactggagaggatgtggagaaataggaatgcttttacactgctggtgggagcgtaaattagttcaaccattgtggaaagcagtgtggcgattcctcaaggatctagaactagaaataccatttgacccagcgatcccattactgggtgtatatccaaaggattatacatcatgctactataaagatgtatacatgcacacgtatgttaattgtggtgttattcacaatagcaaagacttggaaccaactcaaatgtccatcaatgatagactggattaaaaaatgtggcacatatgtgccatggaatactatgaagccataaaaaaggataagttcatgtcctttgcaaggacatggatgaagctggaaaccatcattctcagcaaactatcacaaggacagaaaaccaaacaccgcatgttctcactcacagatgggagttgaacaatgagaatgcatggacacagggtggggaacatcacacactggggcctgtcagggggtggggggctgggggacagatagcatcaggagaaatacctaatgtaaatgacaagttgatgggtacagcaaaccaacatggcacatgtatacctatgtaacaaacctgcatgtgatgcacacgtaccctagaacttaagattaaaaaaaaacatttcttccctcatgaggtacaaagccaagcattacactggggccatgatagtccaggttgctgaaagatttagatctaaagactgaaaattgggatatatattgagagagagagagagagagaacaaatggtaacctaaatttaataaaataataatagacaaattagggtaacaggcatatgagtactttttgttctaacaattcttttattttcaaacttatctatgatcttacatttatttcccaataaaaaggattttaagttaaaaaaagaaagtttttctttagtaacattttcacaactagggcctttaagactgaggaaatactccaagctctgagcaaactcagtaagtataaatccatatgtagacataccacagtaaaatgcaagatactaaacactaatacaatattttcaaatcaaccagagacggaaggcagattacctgcaaaggaaggacaattactttatcacagacttctcttcatcaacgagaacagacaatacaggaataacatctcccaagttgtgagggagactaacagatgacatgaaattctacgaccaaataaagcataattcaatgggcagcagttaacagaattaagctgtttccagacatctatggagagatttaactcaaagatgtcactgtaaatttgattgttgagatgtagtaatggatacttggcaaggttattgaattagttaaacgatcttcaaagcttaggtcatgtatcttcattaaacacatggtgctttgcatttactaaagaagggcctccgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatggtgtcaaccgcatagcagttatttgattggcccattcctttataaaatattttatgcttagatgatgaactccacataaattcagccaggagaatgttttccttggcaatctctgggagattacaaatgttcctttttttttttttttttttttttttttgagatggagtctcgctctgtctcccaggctggagcctagtggcgcgatctcggctcactgcaagctccacctcctgggttcacgccattctcttgcctcagcctcccgagtagctgggactacaggtgcccgccaccacgcccggctaatttttttgtactttagtagagacagagtttcaccgtgttagccaggatggtctcgatctcctgacctcatgatccacaagtctcggcctcccaaagtgttgggattacaggcgtgagccaccgtgcccggcctacaaatgttaccattaactcctccttctgctaagaaataaaccaaaataaaattattcacaaatataactgttttgatcatgctttcagatgatatgtaaagtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccactgtgataatttactacataaaagtacaagttacattatataaaaagaatggcctggctcagtggctcacgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttgaacctgggagatggaggttgcagtgaactgagatcatgccactgcactccagcctgggcaacaagagcggaaactccgtccccccaaaaaaaatgacaccaagaaactgaggtttctagatgagggttacacaatgtggatctaaaagcaacagggaaaggaaaaggatttgggcctagaatgtggggaattttagatgctgcagaaagccttctggtgtctttctagaatggctggattttggttaaggcaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcgcaaaatccagcattagcaaagaacactgccaagtttaccaaagaacccctcattctcaatatctgatcaggttcttcattcttcaccattctgcaggtgatgtctgatcaccctggccagtcttcagcaagaattctttcagggcggtttagccagaatctcccttactcctgatgtttcctcttagtgattttccattcactgacccctgcattgctcctgggctataaattcccacttccccatgctgtattcagagttaagcccatctctctccccagctccaagactgtgttgcagtggttcctatatctatggtgatggtcttgaataaagtcttctttactgtgcatttgaagtatcactgaataattttttatttaacaactatggtgttgaaactcaactaggacagattcatcactggatcctgggcctctcactcagaaccctaaatgcatgcctttgaagtctttgttgtcatttctgactgattagggatccgttggtgaatcagattcctgagccattgttccagacaaaagcccgttgatggctaaggacagattttgaatctgaagggatgaatattctctctgaagctggagtagagtcgcaggcttcttttgaaagcaatcctctgggcaggaaggtcttcgtgtgggcttcttgttctgagtggtctattctctgagtccctaggctagaagtctcttctttctggctctctttttctgagtgaggggttattccctgattccctgggctacaaattgttcttcctggctctctataaaaccactctgctctttctcttctctctattggatcctgcttctcccatgggagctctgtcacctgaaacccctcttctcaagtctctgctgactatttccatagctggtagtcacgacgaggagacaactgtgtagggtcaatatctgggccaaccatcctgaggaactgtgaggtttagaactggaaattgtcaagagaatccgaacccagctaccatataagagagttcaacttatgttcaatgtgaatgccatggcaatattaaaaggtaagaattcgatccatacgtacttgaggtaaataggagaaacctagaatttatgtaaacagtgagaagattggatgcgttttccgtctcatattttaatactggcagcatattatatatgtcaaaccatcaggcattcagaaatacatgcttatgaaaattttttgcaccatcagacaaaagacaagggtagaagacatttgtaaccctataaacactagtaaattaaaaacagaaggaccttaatgtcctaacatacctgtgttgtgaaaggctgccctgtgaaataccggatttcttaaacatattttaaaaatcataggcgtcaatattttttagatatccttttaaattttctcgttattttacaatgcctatttatttatttagtggctctgctgattttgatgtatatccaaaactttatattttctttaaaagatgttttatacaactttatgtaaaatgtttctgtatcttcacattctctccctgtccttttgttttgctcttatatggtggtcctgagtcttttctctggcttttcaaacctagtaagactatgacactaaagtaactttgcccgtggtttgataatgccttctaaagcacatcctaagctctcgtgcatacaggggtctcctttgagctctgtgcttttgagatcccatacacctaaattccagtactccaaatcagtactgctcagttttagtgactaagtttaaaaatgtattttaatagcaagttagtttagtgccctcttgcttctttcttgactgcttgtatacatgtatattcctttaaatgaatcttggaatttatttaaaaatattaaattatactaatgaaactgtataatgttgtgaattcataagtgaatttggaaagaatttgtctttatgatgctaaatcctttttatccaagaatcatatgtgtctttatatttattccagtctatatttatatcactgagtaaatacatagaaatgtggataaatacagctgtagttacagatacaaatatagatatagcctgttaaatctatatctatcccatataacatatatacatgttatatgtgtgtgtttatatatatatgtttatgtcattaaagagctcccttaatatttttcttttatttcccataaaatttaggtcgagcttgaattttgcttgtataaacaagtaaaaatttatactagttttaatactgatgtttagacattgtatcttattttagtgctgaatattttcacaattattataaatatcatctaataataataatgtacctgataaaaatatttaaaattttacctttgaattattttattgttgaattaaaattcctttaatatgatagtcaatttctgttttatgctttctctatgcatatgcaaattaatgtatccacttctctgtctctatgtagtaacatatgaaaatcaggcctctcttcttctaatggacatacacatgtttgcatatagaatatcagaccctttatagcatttaaaacctttaaagacatgaatattgccttttaacaaacatattttagcatgtactgagaatcccctatttatttttaatttgggctaatcaatacgattattaatattactggattaccaaatttggaaacacactttcatcccgaaggtggatatttgttttttttttttttttgccaatttcttgtcttactgtttcaaatattgttggatattatttgtattttatttggcattttagtatcaacatttgtaattgaggtactctacatattttttcatcaatatctggtgggtttcatagttactgctatattggatttgtagtagacattgacaaaaattattcctgtatgttttatagctgtatgaaggaaactaatatattttacccctaaatatatttccttgatatatttcaaaatggctattgagaagggctggaaaagcaatgttagctgcaaagctgtcttggggagatttgcatcggtagagaatctgccctgatgcagccaggttttctctgaggtctgcccccttgtctggatctaggaaaggttaactgagaggctaagtctccaaaggtctgaaagaaacattttctttctattctctctgaggactactcccagtgaggttccacctatataataagtccactgttgctagccagggtcgttttctcacataacctttttctttcttttccctgtgatccaagaccccatttttctgtaaacttcatgtggtagataagcttctgcacgcatcgtgtgactgggtcttcgttctaagggttccagtgtacacacattacagaaacctgcatgccttttctactctttatctgcctcctattagtgattttcagggagacttcagaagacaaaagggacattctcctttagcctattctcagaccaattcccccaacatttaactgattcctaatagcttaaaatcactttgaaaaatccatatatttatatccttttcttccctctatgatttctggtcagcttgggttttgtttttcattccatttacttcatcctcgaaaagatctattttacgtctatttattctcatttatggacattgagaaaagaaaataactttcatgtgagaaatgcaagtcctttgaaataatcaggcccagagagatattcaaatgacacagcagttctgtcctgctcctctttgagctgtgtgttcatctaggctgcttgctgttgccacagtagctataaattaaccaataaggccacaccagacactataatccacaccccataatagtgtaacagtgtgtagccagtcactaataaatgttatttccataagccaatgagaatttgtgacaaacctctttgcgtcatcacacttctggacccttttttgcctttaagtaacttcttgttgcaaagctccaaagggagttcacatccaaggatatttgggtctgtttcttccaggcagctgtcctcactgtggctcaagtaaactctttgaattacattttgtgcttcagctccttccacttagattaacaacatggatttgtgtcaccatgtacagcaattaaaatgtttacacttttcccctcgagagcactgatgtgttttcctgagcacttggaatagctacgtagtgtttcctgtctagattatggtttctcaaccttggtgctacttacctttaggaccagaggattctttgttgtgggaggctgccctagcaatgataggtgtttcgtttgacctctaaatttcacacctccaccagtcttgacatccccacgataaccctagacattgacaaatgtctcctggggaaaactctccaccagttgacaggtaaagttctggaaatattggatttgtcaattgagattttatgttatccaaaacaaatatttttctttgttcttaaacatctacttccatctacttatctacttatttttacttttatttgtaacttaattccatcaaggagagagagtgcattttctgttatgctaaatttttgaagaatgtattgatattttatgacctgatatatggatgatatgtagatattacatgtttgtattatcaaatttcagggtgataataaaataaatacttataatatttatattgtcactgtatattagttattttctttcttcactacaggagtttttcaacctataggctatgtttcaattctaggttatccagtagattttgaaatgttatgattaaatatctacttctcaagcattcatctttgcaaatgaaacaatcctaagctcttataatacacatcatataaagggcagactagtcaatgtatggttcagaaataattaagtaatatttataagaaaattaaaaatttatatccttaactcagataacaataatccaaattaaaatttgatttcattacataatttaaaatgacatcagaatgctagtaaaaattatacaaaaaatttatgtaatcttattaagctgtgggactttattagcataaattcaaatacaggaaccaaagtaagattgagacctatagtcaaaggttaaaatgtacacattataggggcatgattaaactaatttaaagcataataacatggagaaatattgcaaaacatacattttactgaattaattgttagtatctaatcattttgtgagaaccaaattaaaaagtagctacacacgcacacacccacacacaagtgcaatactgtcaaataaacgatgttcagctacactagaaatcacacctgtgttttctccacagaaaagattaaaaatcgcaataatttttattgtacatatggaggtaaagatactcaaaatattaccctaaaatacattatttttttgagatggagttttgtttttattgcctaggctagagtgcaatggcacaatcttggctcactgcaacttcagcctcccagggtcaggtaattctcctagctcggcctcccaagtagctgagattacaggcatgcaccaccacactcggctaattttttgtatttagtagagacggcgtttcaccatgttggtcaggctggtctccaactcctgacttcaggtgatctacccacttcagcctcccaaagtgctgggattacaggcatgcgcctggccagctttttgacatatttcacgatggctactcggaagactggagatagcttcttctacaagaatagctgaaaagctgtgtttgttggggagatttgcatttgtagagaaaatctgcattgatatagacaggctttccctgagatactcccttgtctgggtataggaatgattaactgagcctggcacgtttacatttctaaaagccatttcctatctatacttcccaagaggagggctgctccctgtgaggtttcatccatgtaacaagaccacctctgctgccaggctcctctttcttccttgtcgtcacctgtcttccacaaagcctgatttaccaacctacagctctgtgttttctgcaacctcaagacagcataggcgtgttgactaccttgcctttcctggagtttttatataaagagtatatatttgtatatctctttataatatacaaatatttgtatagatatatttatatatattatgtaaactccaagtgcatacttgtgcacatatctgtaaacctttttttcctgttaatttgtacattatcagtttgttttatagactcaaataattaaagcttcaagggaaaaatttaaattttcctatagagaaaagacaaatatataggtgacaaataatatttagagtgtaagacgctttttaaaggtatatttgcaatttgtgtcaaaacattgaaatgtacatttgttattttaacaataaaatttcaattaatttaagccaaatacatagtatatgcagaaaatttagcaatatatctatgtagcaccttactgtgcattattgtaaccagccgtctaatataaagaattaaggtagcagctgctttccaaatagcgcatttttttcacagacctattaaataagacaaataacatttaaactttatttttaaatttgcagaatagcagttttcagcagatggtttattttagcaaattccatcttcacattgtgctatgcttttatgagttccagctgttaacggatactattttactgctgaaactatcctgtgtgatataattgctcattatgtgccttaaaacacaagcaatataattattttcaacttggagcaaattaaaatcttatcagcaatttaaaatctctagagtcatcttcttctggttaattattttaaacttgtatttttctctttatgtttttagtgagttctcttatcaaggagaagatctcaaggtgattattcttttttttctcttccatgcacctcgcaggtgtgttaataatttcatttctcagaaaatattctttcatatctatcttacaagatgagagaccttttaatatcttccattcggatgtgataccagtaatggaacatattccagcttcatgaatatggtgatacaaatagttattcatctaacctctttcagtgccaaatgtttactatactcagtgagttactcagttgactggtaatttcttctgaaatcactaatgagaggatcagaggtctggctgttgtctgtacctcatatgactcccagtgcagacaatggtttctatggagcacagacagttgaaaggattgacttcctgcctagaatagtttctgctgtgcttcttatccttcttgtggagatttcagattacctgaattgcttttctatcttaagaaaaaacgcaacaattctcccacctgagaggaatgtaaactgaagtaagttaacagaaccaatccataaagtttttacattgtttgttgcaaaatgcagcgctggtgtctccatcactaaccttttctatccctcattgctctttctttgactgcaataggatacctctatgcaaatctgtattcccgagactgagtgcccttttggtgagctataagcacactcaatggtaggctgaaatactagtttttatctatggcgaaatggaatcatatcagtgaattttttaaaaaggaaatttaactcttgctatggtttgaatgcttgccccttccaatctcatgttaaaatttgatccccaatgttgcaggtggggctcactgggaggtgtttggtcatgggtttggaccttcatgaatggataaaactctcccttagaaatctaaagctatcctccctcctcggtgccctcaggaatgagtgtaccattccttattcacctatgattaccccacccatcctttttgagatattgactacatgtatgttacactgatgcacattgtctgacctatgagtgagtttctggttttcttattttagtttaccgtttgtcctttagtttgtaatgcttccaatttgttctataaatgttctgatgttagggtaaaatccattacttattctatctcatggaatttttatttcaagtatttatttttcatctatatatgtcacatttttcattttataacttttatttttctcctatatttaattttcatttaagtaccttgacatatatatgtatttatctatatgtatttataaaatatatttactttaaggatcttgaaatttccttcttttctgtcatttataaatgacttatttttatcctgttaatatatattttaattatatatgtcttacagcttctttgcatttcagagtttttttttgggtattttgatgttatgctattgaatatctagattttattggctacctttgaataatgttgtgacaggcagttcagtaacttcaggatgagtatttgtctgttgttttaaatcttctctttaaactttgttgagttagtctagagccatctgtaatttggagctaaatgagcactgtcactagggcatgaacctccagtggtctttactgaatatcctggaggtacagaggggattcccttctctgattagaatttggaatataaagagaaaagagaaaaatagaaagctatgcataaacacgtgcattaaaatgaattttatgtgggctttttcatgaaaatgttcctaaggtattttattttttttattgtggtaaaatgcacataacataaaatgtaatctgttaaccattttaagtgtacagttcagtggtactaaatatagtcataacattgtgcagccgtccctaccatccatctccataattcgtttcatcttgtaaaactgaaactctatacccattaaacaatacttccccatttcctccttcccccagcttctggcaaccatcatcgtaccatctctataatgctaatcaagcatagtggctgtgtttcttgcttcctctagtccgcaggtagcatacaaatgtaataaactacttattcatgtcgcatctatttattttctgccttataccaagcttgtgggattctcttaaatacaacatttttatacttacacctatgcaatacccattagcatcgccttcctaaatcaggggaaattgagcttctgtcaggtggagtaacttcctaagatataaaactcagcattgaagtctgtatacttcaatatcctgccctcttctcatgtgtctttactgccttttatgtatgtgttagatgttcaacaaattctcttttttaaactgaatttaagccgtggagcagtgttttgttgaacaataaatatgatataggacactcttcctccttttcatgtatgatcctgttcatgaaaaagagaaattctttcattgtgctagaagcttaaaataatgaaaatgccactttctacattaaacagaaactgaagggaatcaaggtgaattgcatgagacatagaaaacaagtgggaaagaaatctagtataatttgccctttgtgtacctttattatttagcgtttgagtaaatgattcccccaaatatcttcccatctcaattcatgtctataaagtagacgtttatgtctcaccttgtcaagaagggcaaagtctaacataaacatttcccaaaaatgcttcctgctaaaacgtaagctcagtctggctagaaatgcagctcacttcctaaagattaattggtagctaattttgcatgctgttctctgaacttgagtgtaacctgtccgtcaggcatacagggaatgacgggaaaggtgacaacagaagatgaatgctatgtcactaaccttcaaagatgacctgccttttctttcaaattcttgatatcttaagacttcattaattcatctctcttttcccttggttcaacattttgctataccaaaactcatgtgagacaatgacctaatgtaataaaaatggcatttttctttcatgtagttgcaagctaactggcatttttacaatccacatatttcctttgtcaatttttcattctgtattggaagtaattgatgggtatttctgaagggatgaaggtgtttctgtgttcattgtgatccaaactatttctagacctaggggcctttgtaaacaatttgtgcccactgaccaaggatcactgtggcagaaagcagcaaacttgcataagatgtcactgcttcataggttggctttgaaaactaggggcttactctatactcttatgaataaaagacattgatagatgtagtataagattacaatcatattttccttttgacagtcacattataaatcaagatgtattgcaattaatctcaattagctgatcacaattaaaattaataatgtttattattgctgataaaaatcatgtctctcctgttctcaaatgtgcaagtaattcttgtaattttaatacaaatttgcatattattattaattgatttaatctcattggatttggttcatggatccaatttattaaaatattgataatgggataatgagttgtctccccatttcatgtacactaaaaacaacatttcttacaatggtctgcaagcccatcatcatctgcctcatgttaaccgccaaaattcttttatatcttcacccttgatcttaccagtggtcctggccacctcactgtcctctggacataccaacatgctgctgccttacgatcaagactctagttaattttttggcttggaaagatagccctccatatatccattgatcagctcattcaacttcctcaggtctttactgaaacttcacattctcgatgaggcctattcagtatttcaaactgcatcccagctgcaacattccaaaaccccttactcttctgtgtatttttgaaaggatttattgagatataatttacatagtgtagagtgcacacattaatgtctacaagtcagtggcttttagtatatgtacagataagtggagccaccatcacaatgaattttagagcattttcatcacttcaaaaagaaaccccaccttccctagctgttaacctcctatgcacccatcccctactcaatcctaagcaaccacaaatctgttttctgtctctatagattttcctattctgttttcatctaaatagaatcgtacaataggtggccttttctgcccggcttcgttcagttggcataatgctatcaaggttcatgtacgtattggtactttatttctttttataactgtataacattcaatttcatggatataaccttttgtttatccaatagtatttttattgacatttgagttgtgttcagcctttggctattttaggtactgctgctaaaaatacttgtgtacaatttgtgtttgaacacctctttccaataatctgggtgtatacctaggaataaatttctgggtcatatgacaattctatgtttcatatatttagaagccatcaaattattttccaatgtggccagttctagccatagagtatctaactgtggttttgatttgtagttgcctgaagagtgatgctgttgagtatatttttatgggattattgaccgttcatgtatcttcttgggaaacacatctattcctatcatttatcagttttgagttgggatatttgtgacggagttaaaccaatttttctatattcaagatacatatatatatacagacatatagatacgtgtttttcaaatatcttctcacaattttggagctgccttttgacttgcttggttgtcctctgaaacaccgatgtctttaatttttaagaaattttaaatatctaatttttattctgttgctcatgtttttggggttacagctatttctttgctagatccaaaatcctgaagattttcccatatgctttattctacctcttgcatgtgtgtctttaattcatttgagttaatatttttgtatgctttggggtaagggttctaatttattattttgcaagtggtgatccacgtgtacgttgttgacccagtgtgttcaaagactgtctcttcctcattgaattgcacatggcaccactttaagaatccattgactgtagacacatagttttatatatggactctcaattctcttccatcaatctatatatttttccttcatcaatgttgtgttgtcttgattactgatactttgcagtaaggtttggagcatggggtgtgaattatcctaatatgttttctttcttcaagattattttggctattttgagtcccttacaatttcatgtgtattttagaatcagcttgtcagtttctagacacaagtctgttgggatacttgcagggatttcatcaaatctgtagttcaaattgtaaagtactacaatatcaaatcgtccaattcatgggtgtaaggtgtttactaattatttaaatattctttaaacaataatttttaattttcagagtaaaatcttgtatcacattttccaaattaattaatatttctttttttatgctattttaaattgaagtgttttcttaaattcattttggggttttcattgcagatgtgtgcaattgatttttgtacatttaccttgtctgctgtaatattgctgaaataatttacgagttctatcgttcggtggattccttaaaattttctatatacaacaatgttattttcaaataaagttttatttcttcctgttcaatatgggtgactcttgttattttagttgccgatttgccctgcataaaatctttagtacagtgttgactagaagaggtcaaagtatatatcctattcttatctctgaccatagcgggaaagcatcctttaccattaagttgcctgcttgctgttggcttttcacaggtgccatgtatctggtgtagaaagttctctattcctggttcattgagtttttatttttatttttaatcattaaagcttttggattctgttaaatgtgttttccgaatctatcgagatgatcatgaattctcttttcttattctatggataagatgtattaccttaatggattttgggctgttaaaccaacctgggattacttgtataaatttcactttgtcatagtgtataattcttttatatgttgctagatctgatttgttagtattttttaaggaattttgcatttatacttatagtagttttatttttctatgctatttggactaatttttgtatcaaagtaacactggccccacagaataaattggaaagtgaatatttctcttttttaaaaaagctagtcaagaattaatatcaattattcaacactaacaaatattattattataaattattaatttctctaattttaattttcttccttctgcttgctttaggtttagtttgctattcgttccagtgccttaatgtggaacgtcatcttatctcatcctttcatttgtcttttcattttgtaaatagtgtcttgttagcatcaggtgagctccccaggttggtagtactccatgtttgttgctgtacaacaatgacaggtaatatgtcctgaagacaatggaaacttaaccttcaaaatctcctagattccaccttatatgatatgtctcttctattggtcctaatttctaccctttctctattataaaccatgagtacaatggcattcaatgagttctgtgagtctttctagtaaattcttgaaactgagggtgttcaggggaaacccctgaactggcagttggtgtcagaagtgagaatcttcttacatggcctcttcctttgaactgtgcagctggacgcaaactctgcacaatttgggccagaactctcgtgttgactttgtagcctaaagtatcttgtagtttgtctaaccctcaataaatttgctttcatcaaatattgtatttgttaccccaaaattaccatcacgtttttttttctccaaataactaacataggagaaatagccagctgagtttgtaactcgacagaaataagtgatccatataccatataccatataagtggccatttcattttgccttcttccaccaaatcttagcaacctcaaccattaccaagagccactgtaggcctaccagctacaaacaaacgagtatcttgtaaaaacacttcatactcccatttgataattttcccagcaaagagatgcctactttaactctatgcaagtggctcatattcacgaagtctgtagatattattcatgtagagtgagaaaatcatcccagcggtgccagcacattctccttcctatgatctgcttagtttgcaaacatattcaggccatgggtgagagatttgtatttcacagtacaacaattttatggagggcattgaaacttacattgagcattttagtacagtcacacatcactgaatgatagggatacgttttaacagatgtattcataggcaattttaccattttgcaaacatcacagagagtattacaaacacctagattgtacagcctaccacgtttaggttatatggtatagcctctttctcccaggctacaaatctgtgtactacattactgtactgaatactgcaggcaataagaacacagtggtaagaggttatgtatctaaacataattaaacgtagaaaagtatgtaaaaatatctattataatctcatgggaccacttttgtatatgtaatccatctttgactaaaatgttattatgcatgacatgactctatgacaaaaataaaataacacattgtaaaaaaatatacacaggtatcaaacatattaatattgtaaaaataaaaatatttattcagtgtaagaatttgtaatgatcacaaaatgttcacagcttatattttagtacagtttcaaatgcctagtgcaattgctatttatttctgtgtgtattttaaacatgtatataataaatatttttcaggttcaacaatatatatcaatccaactggctcttataaatattagttaacatcaattggtaaattcatatatatatatacacacacgtgactcagtctgtatgcgtgtatgtgtgtgtaaatgtaactgtatgtgtgtgtaaatgtaactggatgcatcctaatatttacccttacctacaagatttccaagactcatttattctctttaaatggtgtgccttgaaagatttaccaaataaaaccgcaatcgtggaatatatcaagatgttattaaattcatcttgtgcacataattgtttctttaaatttatgtttcttgcaaaacttgcggtaatgctcatgcacaaaataattttctaaataaaaaataaaaacattttctcagtcattaattcttaaaaagtatttctccccagtaattaatgcgaattcattcttaattcttaattatagaataatgttgcccttcagagttctgaatcttttgcacgttgtatacatttcactgactggaacatcttctggaatattggcattaattaatctcactcagcaattaatgatttcaaagaaattaaataccattcatattctgaatcacaagggtactttggcacctaatttaatcaagctctttgtatcatcatctacagtttaattacttaacaaacatttctttgtgtgagaaagattgagcaggttattgtgcttttcgttgtatacatttcactaagtagaacatcttctggaatattggcattaattaatctcactcagcaattaatgatttcaaagaaattaaataccattcatattctgaatcacaagggtactttggcatctaatttaatcaagctctttgtatcatcatctacactttaattacttaacaaacatttctctgtgtgagaaagattgagcaggttattgtgcttttttatgatgcaacttttgcttaatctagagataggcaatgctccctataagggacaaagagaaaaatgaaagagcaatagagatgtgacaggcatggaaaaagacaatacatttataaaacaaatagggccacagatgatgataatggggatcaaatcttgagatactgactcagtttataaccgcactgtacaatagagcaaatcatttgttaattattttacaaatggaatctaatttaactaagatgaatacagtgttttaaacaaggcaggtcatcttaaaataaaatagtgggaaaagtgataaaaccaatgtaaaaatcataaacattttataaagaatttttgtcatgtaatttaatatttttctttatttaaaatcacccaaatcaaaataattttatcttaattaacaaataatcatcagaagttaactaatttttactttataatactaggtttaaaaattcttcactatatttttaatcatacatgcttatacataaaatagacatagggtatatgtttacatgttcacaatattatattgtaattgttcctatggatgtggtttttcaatagaattaataagtacttttaaaaagtttcaatttcaatgatatatatgtttgatttttctttgacaaagcatacatatattgataggtaataataagaaaatcttctaaagacattacaggaacatgaataagtaattaaatcctcaataatttgtaacgttttatgtaagcggaacacatttaactgaaaattgcttttatataatactcaaacgagactaaaaacatattaactagcggagtaagtcttcaaattgataatctgaactatagaagaggagaaacttcaagcactcaaatatttgaaatgctacaaaatatttatataaactattatttaacaatttctgtttgtagagtgctatagagtaatccatataaatgacatctcagtctttctatagctttgaccacatttacctcctaattttaattattaatatgttggagcagtgcatacaactagattccgatcttcctttttaatgagtaaaaatatgtcctttgagacagcattaaagaaagagcaccttgtataaattcaatgccaagagacaagatattcttgatgctgaagtcttgttcttttatacagcaatgtaattaataagaagaagaaaagcaggacatagagatggagtctattttcatcaaaaattgtctatagattttgatgataaaatttaaaactctactatatttagttagtcacaaaaaactaggttgtgggaacatatttggtcaataaaacacccctaccaaatgccgacaagaaaaaaagttaggtaccacctttcttctctgcagatggcctgagatgggttaatttgaaagaatgcttccaaacctgaggtgacccctgagaacagcataatccactgctgtctcccacattcagtttctcagtctgtgctcttttaattttggggggagggaagccagtcctttaaagcgatcttcagcatgatggcagagccaaggagtgtggacaggtggcacggtgtctgattttgttccagcagccacttgggctttctctgggtcttctctgccctcgggatagcactactattgaaaacatgtctttgtgacattctctatgccaggaactcccaacatattttccttgaaactgatgaaatgaaaaaaaataaaccaagaggtgtgctgtttgtttctgtttcctcctttctgcagcccttcttgatcatctaatatttttaaatacattgtcgatcaccaaaaggagcataagggctttattggtttgtagcagatgtattcatagcccagcccctattccttagctgtagctgctgggaagaaaaccattcttaacactctacaaggtctcatctccagaatttgcaccagtttctagctgaggactttctctagcagcacgggagcttgttactgggcatgaagtgggaagaaaaggtgagggtaactaagaagaatctccctggattcagtgatgtaattctgaggcatgctccacatagcttcccataaaattaagcccagatatctaacacaggaacttacctcttaacacgtgtggtattggcttttctgtctttcctgttttattttgttctcttttccttgtctcactttcgctgtgtcctcactcctgctttaagaatacccaaacaaatacgttcatttatttttttagactctcagaacacagttgatagttgaacttgtaatctatgataatcagcttggttgctgtattgacaggaagatggtgaactcacaatgtctaattaagatacaatttaaaaaatatattgtatcatgtccaaagacttaaaaagcctaagcggcagcgtcacagtttcttctttttagtttgcatggtttcttaaatgcctacaattattttaaaggaagccttgagtctaggaaaaattgagacatatggaataaattactaacccatttctccttgaaatccattagatgtttgatgattcttcacatatatttctgaactgaaaagctagttgggaattatttttataagcatatccttatgtaatatattgtttctaagagtgaatggaaggtttaaagattaaattattctatccagagaataaaaaacaattatttcacaaggagaacatgtgtatgttgacacgacattttaaaatctagattttaaaataggtcccatataattttgagtcaattagaatacgtttgtatcagtctgtctacagttttacacctgtcaaatgttacttgaactaaaagaagtaccttgaacaattttgaaatttattattcctctgaaactgatgaaaagaatgacggtagagtgaaatttggattggcataatttaggagagaaattattccttggagatcaacctctgccaagatagtttacaatgacattgatactttttgatttacacaatttgttatataaaaaatactaagacgatgacagataatacacagactttaattaaaattgtactaaaattaaaagtctaaataaattacaagtgtacgtggtacatctaaacgtatgtttatatattttatttgtgcattttattcctagggttccttttgctttagtttgtaaaacgttcttatttttatggcagtgtagtatatactaaataaagaaaaatcaggaaatagaaaatgaagaagaaaacattagctattgtcaaccaaataaaaattgtgcaatctctaagtacatgaacgatgtattatttgtacagcatgtacaatgtttatgcttcacagggtgaggtagagactgcaaaacattgaacctgggacaaataagaaagaaaggaaattttcacaatatattaatattacagaaaatgttgaacttaacagttaagatacaagtagtgaaaaatgatagtatttaaggagatctagaaaatgtcatccataccagtaatgtgtgagaagtattagaataatgcttgtatttctggattggcatcgatttctattgagactggaaacatactagaagtgagcaaaaaagaatttaaatagtggatacttgagttttatacctaggagttcgagaaatacattttgttactatcaaagcagttggcacaagagtgtacaacattccctaattgtgtctatgtggtgaagacatagacaaacagaaaatagcaaaacagaaatagcaaaaaagcacaaataaattttacctgtatttttacgtaaaagccaattagagtaggaaaacatgaaatttgtgttttatcgaaatttttctcttatagtatagttgattatattactggaaaaaaattgaagcattggtatgttcacaaaaaaaagtaaaagataaggtcaaaaccatgggaatgcagggagcagacaaaatacacctaaacactgatactgattttgccctacggacatgtagcaaaatgaatgagtgcagattcctatggtcatacatcacataggacagtaaagaaatacatagtgtttcccaagatagggcatcacacaggagctcttccctaaagctagcaccaaaatttatctcctcagtataaagaagaatcagaggtaaattagtctcatttcacattccctggaaatggcaaataaaaatgacttgagattggacagatttaaagaaactcaatcattaatgatttacagcaattaatttaaaaattgtttaaatgtgctgtccaaacatacgtccaaacacctttaggccaagaattaatataatgtggtcccagaatggtggtgcctttagtagactcacaaaaaattcaaattctctttggcaaattttcttcttactaatatgcaaaagtgcacaataataattttcagagaaaaataaatctttgtcattcaaaggcatctaagtacgcaaggaaatgatattccaccatttgaaaggaaagcagaaaaagagtacaaacagatccacagagtttcattagtagaaatatcactgttagattataaagcacatttgctttcaaaaaatttaaaaaaaggaatatatttttaggagactaaaaagttgatgtagtaaatttgaaaagtagtttgtatgtagtattttaaattaaaaactcaaaaatgaactcatcagattagacatggccatggtgagagctcataaatatttcagaatgcattacagaaaatttaaaaaaaggcacaatgtggacagaatcatgaagagacatggaagatacagtaagaaagtgtagcatgtgtttagtgagtgttctcatagaggaagggaacggggaagggacaatatgtgatggtattttggctgaaagttctctagagttttgtaagacactaatccacatattcaaaacttctatgcatgctaagcaagctacgatggagataaacctacatctacatatctcctagagaaatagtaaacaatcaggaagggaaaaatatttcaattagcactagaaaaatcaaattacctttaatcatattgaaatctgaaagcatgaaaggtaaaataaacaatattatttgttaagaataataatgccattctgaaatcctcaaccaagaaaaatattcatcaacctatggctaaatcacatatttagagacaaaaaacaaaacaccaccagcagaattccactaaagaaactcaaaggaaactctgaaaacacgcttcagaaagattgaagttctgaaatcaaagaatgaacacagagcaaaatatattgtaaacataaagatagatcaaaatagaaaattaggtgttgaaacaaaagaatatttaaaattagataagcactgcaatatgtatgttaggaagcaaattattagggctgaagtattcaaagaccccttaattgtctgacaagagcagaaaggtatgactttgcaactcttttttttttttttttttttgagaaggagtctcattcaccctttctcccaggctggagtatggtggcgtcatctccgctcactgcaacctctgcctcccaggttcaagcaattctcctgcctcagcctcctgagtagcggggattacagccgcgtgccaccctgcctggctaatttttgtattttagtagagacggggtttcaccatgttgatcaggctagtctccaactcctgacctcgtgatccacacgcctcggcctcccgaagtgttgagattacaggcgtgagccactgcgcgcgaccgactttggaactttaataaattgactggacattatgcatttctctgttgtatctatgaaaacaataaaaataaaagtcataattttaaaacaagaagacagaaagtgataggagaaaatgagacattttatatatatatatatatatatatatatacacaacaaattactaatacaaaattaagtataaatgatcaaagattaacttaaacctaagtagacaatgtttttgttaaaatacaaagattggcaaaatttaaaacatccgtctctatcatagttacaagagacacaactaatatataaatttacagaaactttgaagttcaaacaatacagatactgtgtatatatgatatacatacaaacatactacatgaatataattttttaaaaagttgctatgtagaccaaatagaatgtaagttagaaacatttattaaaataagttagtgtaaccagtgtgataaaagttttaagttattaagaagatgtgatgacttaaatgtgtattagcctgatacatacatatatatatacacacaaaccacacactctctcacacacacatacacacacgtatttagagagagagtcaaattatataaagcaaaaatatcagaaagtaagtagaaatggataagcccccaaatattatagacatttcaaacacacgtctttcagtaatagataaaagaaaaaattaaaagagtaagttttaaaagaagctagtggattttaaaacgggcaaatattatataaggaacttgaatattataattcatgttattttcatgttcatacagaatacttacaaaaattaacattttctagaccataccacaaattcaaacaattttcacggaaataacgtgacacagaatatacgtcctaaacaaacagcaatgaaggcagatatcaatacaaaaacgaaagttagaaacataagtgtaataatattggttggaagccattttattgaatattgaaatattttaaaggtgaatagtcactacaaataaaccaaacacttttgtgaggccactaagatacatgtgtaatgtgtaatgcctccttttataaggagtaaatctgtaaaatcacctgggctatttgacaactgcaaagtgaatgtgagaaggagagaaacagtgagagagagagagataaaagcagtaaaataaacataaagaatgaaggagatagccaggcgccattgttcacgcctgtaatcccagcactttgggaggccgaggcaggtgggtcacctgaggtcaggagttcgagaccagcctggtctaacatggtgaaacccactctctactaaatatacaaaaattagcctggcatggtggcatgcatctgtaaccccagctactcgggaggctgaggtgggagaattgcttgaacgtggggggtggaagttgcagtgagtagagatcacgcgactgcactccagcttgggcgacagagcaagactccgtgtcagaaaaaaaaacccaaaaaacaagaaagaaaaaaacgaggaaatagtacacgaaaaagcagaattaaagcaactgggtatatatttaaaaatgcaaaagctcactttttcagaaaaatattaaaatattaaatctaacaaatatctaggtagactgatggagaaaaatacagaaaatgcacaaaaaagcaattacctggaatgcgaacgttacaaaacgtcagcagttgtagattttaaataaacaatgatttttgagttcaaccatgatggggcatattgaaaagaatctctcagaaaaaaagaaaaagaaaactgttataaagctatgtacaaaatgttaagcactattaaagtcttccaaatctaccagttacggagttattggtcttggactaacactcctgaaaagaaaaaaaacaaacaaaataagacaatacctaaaaacctggataaaatggcctaccgtgggcaccggcaatgcatccaagcaggtaggacctgggtgctacattctctttgtcagaacacaaagcattcatacactcttctcaccctcactttcaccttttaatctttgatctactattaaatgtattcaacattactatcaatcctttgctcaaaatttctttactcacattttgcttgatgcacttggatagactgttcaagaaagtgtgagtagtgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcactacctatttccagaattactctacagctatgaaaatcaagattatgtgttttgttgaaaaaaaaaatggaatatatatcagtggaagagagaatccagaaatagatactcacatgtatgtctaattgattcttaggacatatatatatgtatacacacacacacacaaacgtgtgtgtgtgtgtgtgtgtgtgtatatatatatatatattcaccgttttgaagattatcatctccaaatagggaatatatatatatatatatatacatatacagacacacacaaacacacacacacacatacatattgcagtctgataagataaacagcacattgaaacaatttctcaaaagacttgaatagatacttcagaaaagaagatacatgaatggtcagttagcataggaaaagatgctccacggtttagtcatcagggagatcaatcagtgcaacaatgagataccagtacatatccataagaatggctaaaattaaaaaggctgaaaatagcacctgttggtgaggatataaagcacttggaagtcttatacttgtaggaatgaaaaatggtatggctcctttgaaaatctaacagtttcttaaaggttaaacataacacaaatcagatagacagtcattcccttcctaggaatttacacactgtgtctgcacaatgatctgtatgtgtgtttccagaccaacctgaggggcgggctgctatttctcgtggctcagtaacaagacacagatgaactggggaggaagagagttttgacttctgcaactggttacagggaaacggcctggaaattatcaccagaccaactcaaaattggaaagttttcctgggctaatgtaccttctaagctatatgtgtatgtggaagtgtgcattcatctaaatacataagtgattaacttcttttaatctataactaagtctgagtcctgaagaccttcctctggaacctcagttaaattcagttaatctaaatgggtctaggtgctgggggcccttatcttgtctcctgctaaatcacagaggtttggagagtcccttcagatctccaataaacttgtttgtggaggcctggggagtttcttcagacccccagtaaaacttatttaatactaaatggctcctgttaagaatgccttcgttatttcgtcatgctttaaggcccaggaaaaacctaggcaaaactcttggtgggcttttgttacattccagcctttgtataagggcactggcttcttttttttttttttcctcttaatatttaattgaaccactcagtcggtactgaaacagttgttacggaggcctgtgttagtgagacctggcctgccacgtatggatgctcatgatagtttcttcataatagcccaaacgcggaatgatagaaatgtccaataacaagtgaaagtacaaacatacatggtatagccacatgaaggaatactactcagtatttacaagacattacagatggattttaaaattacattgatgcatgaaagaaggcaacacaaaagaacacaggtatcatttcatttatagaaaatggttaaaaatgcaaacggacctgaagtgacagtggctccttggggctgagggttgaaaggctgatgaactgcaaaggggtacaagaaactttggggcatagggaatttcctctatcttggttgtggcagtagttccgttagtgtatccatttgtaaacgtgcattgaattacacattttaaagtggtgcagtctgttgtaccgaaattatgcctttataaagttgatttcatcatcttaatttctccatactagcaattagcagctagaaaatgaaattcaataaaacataatagagattaatagccagaatcattacatgcttaacaatacatgcaatgaagcaggtacaaggcccctaaaagcaattggtgagaaaaattaaagaaggctaaataaatatatatcatgttcattgattggaagactcaattttgttagcatattacatcaacacaattctgattaatatttctagtaggagattttagagaaatttgaaagctagtttcaaaatgtatttgaaaatcaaagaacctagaataagcaagtcggtcttgaagaagcaataagttggaggacttactctgctagatttcaaacctgattttaaagctacagtaattttaaaacagtagtaatggtgtaagtattcataaatatatcaaagtaaaagaatacagattcaaacaatatgcccacatatgtacagttattgatttttttttagtagaatcttttttattcataaaaaatccatcaaaacaaaaaagttttccagccacacacaggaggggtatgggtgggggaaggtgtctgtccatctatccctggcccccagcccatgtggttttggcagcaataaggtgtgtggggtaatgacccctgaaattaaaatggtgtgtgtatgtgaaggaaaggcgggcaaagctatggggagcggtggagtggaaggaacaaaggaggtcagtactgggaacgctgaaggtgggaggccatttcataacattacttgttgatgaaattgccatggataccttctttgcccatcagcaggcctagcgtcttggcagtcatggtgacaatgacgttgaaggtggggactccaccgatgctcttcatatgaagatccacggtcaattccccatcctgcagcagtgagtccaggaccacagtatatttctggccccccagtgtcagtccattcatgacaaagtttgaccagtctttgccaaccaggacaccaacctcagctggcgtgatgttgaggaaggttttccctgggatggcggcccagatggaaggtgggtccttgttgccaacaatggccgtgtcctaacaggtcccgtccgccacgaggctgtagatggaggtgtccacctggccgttgcgttgctgcaggggctcctctggtcgctgctgttggggccgcctgggctggcgggtgggggaggcggagagcccgatgcaggtgctgtcctcctcgccacgactctgctagctgtgcagtagccctcgctccgccacttaaaaaagaaaaaaatatatatatataatatatatacacacgtgttatatatattgtataatatatatacatgtatacatgtatatatgtgtatatatatatacatggcacacgtgtatatatatataatatatacacgtgtatatatatatataatatatacacgtgtatatatatatataatatatacacgtgtatatatattaataatggcctacatctatattaataatatatattattaatatatatacacgtgtatatatattatatatatatacacgtgtatatatattatatatatatacacgtgtatatatattatatatatatacacgtgtatatatattatatatatatatacacgtgtatatatattatatatatatacacgtgtgccatgttggtttgctgcacccattaactcgtcacttacattaggtatatatcctaatgctatccctcccccagccctcaccccatgacaggccctggtgtgtgatgttccccgccctgtgtccaagtgttctcattgttcagttcccacccatgagtgagaacatgctcgcaccgccgcttctaaatgttttaaaaacaaagacaccaatgcccttcattggggaaatgaaagacttttaagtaaaacgattttgagtgaaataatatttgttgttttaaaaagttaatattaaccactctccatcatatattgaaattaacttaagatgtgaaagttaaattagaaaccttgtaaaggaaaaataggaaatagtttcatgaacttgacacaggaaaatatttcttagactagatactgtagcactcaccacaataagaaatcaagcgaattgcacttcatttttaaaaagcttctccttattatgttgttgtttaacaacttaaacgctatctctagaccaggaataattatttgctatataatacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggtgtagtttaaaagactgaaaatattaagtgtgtgggaatgtagagcaactggaaatggcctacatctttcatagaaatgtaaaacaatacaaatactttgcaaaactctgtccaacattttctacccattcaccaagcaactccatccctagctatagatacccaggaaaataagtatgtatcttcacagaaataattgtatgagaatattcatagttacttatgcacagtagttaccaagtaaacctgtctcccatcagaaaaatggatatcaaattgtgtgataatcatacaatcaataggatattacttggccaaaacaaaatgaaacaagggaaaaacacaatcaaacaaattagtggcatatatacccacctgagtaaagagaagtcggccgggtgcggtggctcatgcctgtaatcccagcactttgggaggccgaggcggcagatcacgaggtcaggagatcgagaccatcctggctaacacagtgaaaccccgtctctactaaaaatacaaaaaaaaaaagaaaaagaaaaattagccgggcgtggtggcgggcgcctgtattcccaactacttgggagtctgaggcaggagaatagcgtgaacctgggaggcagagcttgcagtgagcctagatcgcgtcactgcactccagcctgggcgacagagtgagactctgtctcaaacaaaaaaaaaaaaaaaaaagtcaaaacaagagaacatactaaatgattctatttttttatttatgatttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttttgcaactgcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacagtaagttaagaatttcagttacttacatccctcagtcctgattaaacctatttgatttcaccagtttttaacccatcatatgtttgggtttcttctccccagtccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacagtaagatctataggctcaccgtcatgaaagtgatgaatgatgtcctgtcttctctctgagacactaaatgctctctccatcaaaaataatttcatccttcctgtacttctaggaaaacagaaatgggtattttaacattttgttaaagttggaagacagaggtaccaaagtatttagcaactttccatgtttgcaatcaggtgggggtgggactagagttaaactgccatttattgatttctgacacaggcacagaatgacctgttttctccaagaggctcaatcatgttttcaagaatcctctctgtaccatataagatcctgcagacaaataacatctagtctgttgttctaaatgtctgagactagtgaacttttattcagttcaagtttctgtggaggcccaacaggcaaagctctgttctagtgactctgagggaaacttggtgatagtagccagtacctgctctgaggggcttcaagaggagtctactcctaatagaacctgtgctgtctataagtgacagcatcaagagcagggagtaggggccgtgcatggtggctcactcctgtaatcccagcactttgggaggctgaggcgggcagatcatgaggtcaggagtttgagaccagcctgggcaacatggagaaaccccatctccactaaaaatacaaaaagtagatgggcgtggtggcaggtgactgtaatcacccctgcctaggaggctgaggcaggagaatcctttgaacccaggaggctgaggttgcagtgagccaagattttgccattgcactccagcctgggcgacagggcaagactgttaaaaaaaaaaataataataatgataaataaaaataagaataaaaagcagagagtagcttggtgagagtgaagtcctgcttcctggggcacagagtcttgttgctaaagaggaagaaagatcgcatccgagaatgtgtggagatagcagtgcagtgtacagagcagggactgtgggcctgtctactgggctccatccaagttgcttgtcttgtctgtccctcagtttcctcacctgttcagagggtactacaataatacctacctctgtaaattgctgcagtgaattacatgagctatttcttgtcaatctcctagaacatttattggcacacagtaaacactatctattagttgttcattctgctgtttctaaattaacacaaactttattagcatttgggcatatttccttcatggccttatggtgttatgtgtcactctttatgcttcagatatgattcttaaaatcataactgaagatatgatttaaaaatcaaagattttaaaaatctttcacatacttgtccttgaaattcccagtaaaagggaaaccatcagtcccatagtcctaggggccttcccgactgtacgagaaatcactacttcatgccccagtgcagtgttttagaggagaggctgcaaggcttgggaaagtggccccgcattcagagtcagacctcagggactgtgaattctgactccacttcgttgtggttgaatcatcttgtcaacttccttgatgtgcccttgaggttctctttcttcatctctaaattttggaggatcagatgccagaaagtcaggagactgaagagtaaagatgtggaaatccctgtctagaccctggtactggggagagttttgtccttgggatggacctggctcctgtcctgtaggcaatgaccacagcagcatgtccagccttccactgaggcaggcgtgtctgtcttttctcagaatatgaagagtgcaaagatctcataaaatttatgctgaggaatgagcgacagttcaaggaggagaagcttgcagagcagctcaagcaagctgaggagctcaggtgaggggaccccatgggggcaggcaggggtcaggtgtgtaaatctctgaagtacagcagctcggtggggagatgtaagagctaagctgggccaggggaagggcaggaattgccatggcaggctcgctacacacaaatatttatcaaacagagaagaaggataataaaaatgtatgggttgcagttgtttctcagagccttgttttctctttttcaaacaagtaattgttgatgtgaaatttacataacacaaaattaaccaaaggagtgtgaaccacacagcagcattcagtatactcaaaatggtgtgccatcaccaccccacttacccttagtgagaatcacctcctgactgactgcggcttctcattctttcactcaatcaatgttgccttctcgaccctgtcattcttttcttctttcgtcttttcaattcgccccatctgcacctggcctcatttctgtacatggctttgtatctagtggccgcaagatgcactatgtgtattttcacatggaaatgtccatggccagagtgaggaactgaaaggatgtctttttgaaacggaattaggaagacacctacttttgtttacagaagagaaagatgaatggaacatcatcgaggatcttgcaggagccctctctgatacagaggaagcctgtaaaccattttctattctttctcttggccacagacattcctttaaacatgtgctgaccttctgcttcgaggtctccttgaggacattgtctcagaaatctctgttgcaatatttgagcggatcactcaaccctttccactcttaaattttctctaccgtctcaccttaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccaggtaaggtggccataggccctgatgacccaaaatcccaggcttatgagagactccagacctccatactttcacaatgacagttgtatcaatggtgtttttttccactaagcttatgtggccatgacatgaccaggacttcttgggtaagagcggagatgggaaacccatggggttggaggtcacagtattgcaagtgtccctcctcccttgatggaaggtggtctttggagtatgaggcagcatctgtctagttttaaaggacaggaaggaggctgcgatgggagcaggcttgttagagtgaaaagagctctggactaagaatgaagattcccaggctgtcttttcggcaatgttcttagtaactgtcagagagtgaatgacttgtccttcctgaatttctctctctccgtggcagacaaattgtctcttgcaagggtctgaagcattcaaatgtgggaacacttacaactgctttccaaaatgagatgaaggccctcgccgtgtgatgttggagaaggcactttatgtgggggcgttttgtggtaggaagtgcttcagactggagcactccccatggatagaatgtccctgaataacacagcagaagccacttggaggcttgaaatcttctgatgcatagaggactgtgggacaagtttgtctgcttctaagagaaagaattaggtttgaaatgcaaactgtgacgggacaccaagcctgtgcctgggaatcagatctggcaggatgggggacacagctgccaatgtccagagagaggctgcacaagcctccagtgatatgggaagcaaaaggtcttttcaatatttggccacatcttgatggtggccctccagatcagaaatgcattgcctgatggatcaggaaaccatgccagggcattctgttaaagataaaacatgagagttttcagttgaacggtgacccatgcctagatgttcatgtctctgttgcacattgggctgactgtgcttgcagactgtgaagtgggaaatatctgaacgaacacttctgtatttacagaaaatgacaacgatgacgatgaagatgttcaagttgaggtggctgagaaagtgcagaaatcgtctgcccccaggtaacactgaatactcaggaacaattaatggatggtaacatatgaggaatatctaggaggcacaccctctctggcatctatgatgggccaaaaacccgcattcgcttggccacagtatgtgaaatataacccagcttagacacagggtgcggcagctgtcatgtttctctgtgtgtgccgagtgtcatgtctgcaccgtacagggatagctgagtcttcatcctcctcagctcctatctgtccagtgcaatgaacagcagctgctctcttcctctctggttcccatggcagccatgctctgttgcagagagaacaggattgcatgttccctcttaatgggaacgtccattttgctttctgggaccactctcttaatgccgcctgtcaaaaccagctaggactccctggggtccaatccctctgtgtttaatcttctgtcatctctgtcccacctggctcatcagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccaggtagcctctgttttccttgtgtctcgtacctctctctaggctgaggaagataaactctgaagacaggctctatcaacacaaattcatttgaataaaaaactgtgatgggtttctaaacagatatcagggagtttttttgtccttctcagctaatgtcatgcctttgtctgccagtccccagtatcaagttactcaaccccaggcaagtgtgacaatctcatagtcacctgagtgcaggaggtgcacaggccatatctgtcaggcctcctagcttcgattcagtatttcttgtcatctgtgattaagtcatctgtccctgaacaatgcccatggagtttctatgcctgtttaaggaagctggcagccttgcctttgtatttggaaatatcgttccccaggcttcactgctctcagctttcatctggatctcctttaagtcagcttgcttagctgcacagtcaccctgaaatcaggacggaaacttttcttctttactttgctgatatatttccataaagcaaggctggaccctggttctccaccctgtcaatgcaatggctgatccaatgtttctttgtagcatcgtggattttttttttttttttttttttgcgatggagtcttgctctgtcacccaggctggagtgcagtggcaccatcttggcttggtgcaacctctccctcccagattcaagtgattctcctgcctcagcctcctgagttgctgggaccacaggtgcacaacatcacatctggctaatttttgtatttttagtagagacagggtttccccatattggccagggtagtcctgaactcatgacctcaaatgattcacctgtcttggcctcccaaatcacagattctttttaaagcaagagttgttcaaatttatctatcagtcgtgtttcatgtatagatgcctctaaacatttaatgtccatgttacctggtgatataagtccgtattgcagcaacactcttagaaaattgtttgaccaatttttggagatttttttggggaaaaaattttgtttaactttgactcaggcagggaatatggcattatggtctacacgtagagggagattttggcctgtgggtctggaaagcagggtcatctaattctcaccaaagttaatctaggacaccctagaatattcctgtcagaatccttattcttgcactgagaatagttatgtccttgtgctatgactggacagtgatttgttcctatgtgaagtatgaattgcttaatgtgacctgcttctctgaatttatttacagaaaatgaaagtgatgatgaggaagaggaagaaaaagggccagtgtctcccaggtaatgttgtggaattgttggctgttaattcagtagtgacatctggagattgtagatttagggaaaatgaggaagtgatgaatagaactatttcttccattcacccagctacaaattgtgctgatttacaatgttgtatgttatttgtggcacttgtattggttttaatttcatagtcctctcaagataggaacttgccatcagatgagccaggtgaactagccaaacagggttttcttgttgatcttttcaaaaaaccagccctggattcattgattttttgaagggttttttgtgtctctatctcctttagttctgctctgatcttagttacttcttgtcttctgctagcttttgaatttgtttgctttgcttctctcgttattttaattgtgatgttaggatgtcaattttagatcttttctgctttctcttgtgggcatttagtgctataattttccctctacacattgctttaaatgtgtctcagagattctggtatgttgtgtctttgttctcattggtttcaaagaacatctttatttctgccttcattttgttattttcccagtagtcattcaggagcaggttgttgagtttccatgtagttgtgcggttttgagtgagtttcttaatcctgggttctaatttgatggcactgtggtctgacagtttgttgtgatttccattcttttacatttgctgacgagtgctttacctccaactatgtggtcaattttggaataagtgtgatgtggtgctgagaagaatgtatattctgttgatttggggtggagagttctgtagatgtcttttaggtctgcttggtggagagctgagttcaagtcctggatatccttgttaagcttctgtctcattgatctgtctaatattgacagtggggtgttaaagtctcccattatgattgtgtggagtctaaatctctttgtaggtctctcagacttgctttatgaatctgggtgctcctgtatagggtgcatatatatttaggatagttaactcttgttgaattgatccctttaccattatgtagtggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgagtacagcacactgatgggtcttgactctttatccaatttgccattctgtgttttttaactggggcatttagcccatttacatttaaggttaatatcgttatgtgtgaatttgatcctgtcattatgatattagctggttatttcgcccgttagttgatgcagtttcttcctagcgtcaatggtctttacagtttggcatgtttttgtagtggctggtaccggttgttcctttccatgtttagtgcttcctttaggagctcttgtaaggcaggcctggtggtgacaaaatctctcagcatttgcttctctgtaaaggatttatttctccttcacttatgaagctttgtttggctggatatgaaattctgggttgaaaattcttttctttaagaaggttgaagatgctggagaggatgtggagaaataggaacacttttacactgttggtgggactgtaaactagttcaatgattgtggaaggcagtgtggcaattcctcagggatctagaactagaaatactatttgacccagccatcccattactgggtgtgtacccaaatgattataaatcatgctgctgtaaagacacatgcacacatatgtttattgtggcactattcacaatagcaaagacttggaaccaagccaaatatccagcaatgatagactggattaagaaaatgtggcacatatacaccatggaatactatgcagctataaaaaatgatgagttcatgtcctttgtaggggcatggatgaagctggaaaccatcattctcagcaaactattgcaaggacaaaaaaccaaataccgcatgttcttactcacaggtgggaattgaacaatgagaacacatggacacagaaaggggaacatcacacactggggcctgttgtagggtggggggagggaggaggggtagcattaggagatatacctaatgttaaatgatgagttaatgggtgaagcacaccaatgtggacatgtatacatatgtaactaacctgcacgttgtgcacatgtaccctaagacttaaagtattaaaatatatatatctgtatatatatatatacatacacacaaaaaataataaaggaaaactatacatatggaaaaaaaaagaatgttgaatattgctcccactctcttctggcttgtagggtttgtgccaagagatctgctgctagtctgatgggcttccctttgtgggtaatccgacctttctctctggctgcccttagcattttttccttcatttcaaccttggtgaatctgacaattaagtgttttggggttgctcttctcgaggagtatctttatggtgttctctgtgtttcctgaatttgaatgttggccttccttgctaggttggggaagtcctcctggataatatcctgaagaatgtttcccagcttggttccattctccccgtcactttcagtacaccaatcaaacgtagatttggtctttccacatagtcccatatttattggaggcttgttcatttctttttactcttttttctctaaacttctcttctcgcttcatttcattaatttgatcttgaatcactgataccatttcttgcacttgatcgaattggctactgaagcttgtgcatgcaccacgtagttctcgtgccatggttttcagctccatcaggtcatttaaggtcttctctacactgttcattctggttagccattcgtctaatcttttttcctttagctcagagaagtttgttattaccgactttctgaagcctacttctgtcagctcatcaaagtcattctccatcctgctttgttccattgctggcgaggagctgcgatcctttggaggagaagggatgtcaggtttttggaattttcagcttttgtgctctggtttctccccacctttgtggttttatctacccttggtctttgatgatggtgacctacagatggggttttggggtggatgtcttttttgttgatgttgatgctattcctttctgtgtgttagttttccttctaacagtcaggtccctcagcttcaggtctgttggagtttgctggaagtccactccagaccctcaaacagggatttctttgtgttgcctattctctcccatgtgtttaaatccagggagaggtgtatacatgctttcttcctatttgttggtagtatgttggctagtatttttgcaagaaaagaaattgaaaaagtaaatatattatatcaaaatattgggaaaatggggcccttaatacacaagatctgtgtctgcactgcgtcaagaactctcttcacttgaatgctgcatgtaaaattcaacccaatttatgcaaagtagttgaagccctgtgtcagttctctgtgctgcaagtcatgatggtagtttacagggagagtctgggtgccctgagttggctcatctgtggcaaatgtactgagcacatgctgcccatttttgctgtgtccccagagcagtcaccctccaccctgtatttagaaggatagttttatttctcttgaaggaaaaatgcctttggtttctgtgaccactccattctgtctcccatcagatcatctgggaggttttgttgtctaatgtctgttggttaaatcttctatcatccctgtcctgcctggctcatcaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagtgagtactccattgtgaaggtgataaagctccagttcatggcccaggtagaccccataatctttgggccttgtgccccttgttgggctgagatttgccatcaccgtgggctgaacctatatatcaatgtagatttcaatcactctggagtcgagtctgaagcacaggcatggggtgggtcagtgagctttgctctcttcctagtctcaggccatgcccgtgccaacctggactgactgtcacgacattgaactcaaggcaggtgtggcaaactcacaccaaactatgcagcacatgcccaggagctgtctgtcagctcagctcatctgaattaaatgtctcttgccagctacaaaattccttatgagttttgttcccaaagcatgtctgtgtggttctttacctgccgaaggccagtgtcacccttgtctacctctcagtgaaagatgtgacccaggtttcactgaatttattcccattttctgtgtcttctaagttcgcttgttttagctcatctgtccatcatgttcctggtacgttttctagataaacagctgacttttcacccacaaaagccataatagctgatgcttctgtgtagaaccaagtttcattttgactcaagagctggtacattgcaccccttcatcaaatctctgtgtccacaatctcataaactatcaaattctgggtatttaatgagagaaagcttaatattgaagtatctctcctatgaggtgttagaactatttgcctacaatttattggggaaaaaattgctcatttgtgtacataaacctaggacagagcacatagggaagataacattccaaaacaggggaattttgcccaaggctcatgaaagaacccaagccagttttctcaagacttgacctcaggcctactggaatatttctctcaaagtctcctgttctcacactgacaagactgatgtccctgtgttaggattggacagaggaatgtttctgtgtgcaaggaagaactgcttaatgtaagagggcccatctgaatttatttgcaggacatcggtgggatcaagtgaaaaaggaggaccaagaggcaacaggtcccaggtgagtctgagaaattgtggagagttaatttgatgttgacacctggagatgccaagtccagggaaaacagtacatgctgaaaataatgattttgtcttgtcagacaagtctgaattatgcctactacattgctttttggttctcattagagtaaatgtttaggtttccatttcttcctacacttatcatttactaacctagtgaaggttgaccatacctcaaaagctgtattctcatggtaactgcagggaaacttgagcacattttatgcaaaattattgaggacatgcttttcatgatcactgttcactgtgtgtcctgagagcacaaatacagagtgtcctttgattccctcatcagtgtgtcacctgaccaattcactgagctcgctctgtgtgtgtgtgtgtgtgtgtgtgtgtgtgtgtgtgtgtctttctctttcatccttttctacctggccctagtctatcccaacataaaggcaataatttgttacctcattaatggatctgtcctttttcttttcaaactcttccttatgttagccatgaaatctagctgggactgtgtggtttctgattccccctggcttattctttactttttcccacttttccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatggtgagtacctttctatgaaggtgataaggatccactgagtcttctggttagggtcatattcctactgcaagtggcccttactgagctgagagatgtcattgccacagggaggacctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctcaattttgtagatcttgtagatttcatccttcactctaatttcagcgtctaaaatccttgctaccatgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatcgtgatcagccttcaggcctcttgaagaatatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattgtgtgttgacacctggagatgccaggtccagggaaaacaagagtgtgttcaatttcatgttttcaacgaaggttgaattactcctcctgacattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgaccactgttcgctgtgtgtcccgagcgcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaatggatccgtcctttttctttttaaacagttccttatgttagccatgaaatctagctggggctgtgtggtttctgattctccctggcttattctttactttttcctacttttccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgttgtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgagaagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatcactgtatgctgtgtgtcctgagggcactaactcagagtgtcctgttactccctcatcagtgtgtcacctggacaattcactgagctcattctctctctctctctctctgtgtgtgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttacttttttaaccacttccttatgctacccatgaaacctagttggggctctgttgtgtctgatttcccctggcttattctttactttttcctccttttccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaattggccattactgagctgagagatgtcattgccgcagtgaggacctataggcacatgtaggttgaatgaaactctagttctacctggaagcccagacaagggatgggtcagtgagcaagactctcttcctagtctcaggccatgcctgtggcactctgattctactctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaaattgattggaaaaatatggcataactgtttgcacaaacttgggacaaatgttattgggataacgatctactagaatagggacactttacccacagtttttgggagaaaaactgaggaatttatatcatgaccagccttcagacctcctgaaatatatctctcatggtgtcgtattcttatgctgaggagcctgaggtccctgtgtgaggattagacagtggattgttatatgtgtaggggaatcagcttaatgtgtctgtccatgtctgaatttattgcagaaattgaaaagaaggggaaggggaagaaaagaaggggaagaagatcaaagaagaaaagaagaaggggaagaaaagaaggggaagatgacaacccaccatgccccaggtaactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacgtaccataggttgaccatacttcaaaagctgtactctgatggccactgcatcaaattttgagcatattttatgggaaactattgagctcactctttttgtgatcacagtttgctgtgtgtcatgagggcactaactcagagtgtccttttactcccttaccagtatgtcacctgggcaattcactagctcactttctctctgtctctgtctctgtctctctctctctgtctttctctttcattgttttctacctggccctgttctatcccaacataaaggcaataaattttttttttttacctcattaatgaatctatcctttttcttttctaaccacttccttatattacttctgaaatctagtggggctctgtggtgtctgattttccctggctgcttctttagttttgtctccttttccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttccatgtttattttctaatctcttccacattgtaggctatgtttaccatacgtagcagaatgtatttacatttcttggttctagtcatttgtattcttcgtgagtgtgagtgtgtgtgtgtctgtgtgtctgcgtgtgtgtctgtgtgtgcctttggcatttaggaagggttgtatagctcatgttaaatattgcactaaaaatgtttttgatggttttcctccctttgaactagacacacttctaatatttggtttatagttttaaattataactttcagcatcaaatatttccatacaacagtcaattacatgatgtgttttctttttactacctcctttacctgccacttctcataatagtatttgaacctaaacatataccggtgacattctgtgattatcatcttgcccctaccttggttttggtttttggtgcagttccaggctcttggtgtctttgtttgggacaccaagagcctggtactgcacggcaccagctggtaagaattaggcttttttggccgggcgcggtggcttatgcctgtaatcccagcactttgcgaggccaaggcgggcggatcacgaggtcaggaaatcgagaccatcctggctaacacggtaaaaccccatctctactaaaaataaaaaaaattagccgggcgtggtggcaggcgcctgtagtcccagctactcgggaggctgaggcaggagaatggcctgaacccgggaggcggagcttgcagtgagccgagatcgcgccactgcactccagcctgggcgacagagagagactccgtctcaaaaaaaaaaaaaaaggctttttttttccctaaggtttaacaacaaaccagccctttggaaagacttgcttcaccactgttaccaaccaacggcctgatgctttccctcagttttgtgattttgacaaaacaagcaagcagcattccctcctgataagagaccaccgacctaggaatgattctggccagactagagaggatgcacagtgagggttttcatgtcctctgcttcagcttttgatgtcagagggccacaaactccactctcagatgattgctaatgccaccattttatgaacatggaccccatggagaggcacgaagctcaattgcacttctgcacatttttcctcctataaatattgctattggaatattatttggtacggctcccgtgaaagatacatttgcagaatgtactcaaattagaagcatcatgtaaagcctataatgtaccgatagtgcatcaacttccctacactatagaaatatctgcggtgtagacatttccacaatgaccagatatgtgtacaacaaaggtggctgcagcattctttgtaatcctaaaacaatgaaacctacctcatctcaaaaactttatttttttatttttattttttttttgagatggagtctcgctctgttgcccaggcgggagtgtagtggtgcagcctccactggtgcagcctccactgcagcctccacctcccaggttcaaatgattctcctgcctcagaatcccaagtacctgggattacaggcacatgccaccatgcctggctaacaaaaacattttgaaaagggttaaataaatcatgcacaaactgaggaaaaatactcttcaaaaatgatggagaggatcactatgatgatgaatgattccactggtcacattattgatagagcaatcagtaaatccaggcacatcctcgggatattactgacctcctattattaacatatgaaaaaatggaggcatgtaaattactcgtttaagcgtataacggactgaattagaattttatcacaccagaagtgggttcctaggtctctgtttcaggattcctgagttacacacgtataaacccaggatttcaggagatacccggttaagaatccggtcggggaggtgggctggcccttgacatggataagtcacaaattagtggcttaggactccaggaagataaaatcttccccatttatctagtgattgacaatgcatgaatactttaaaagctcaaacaagcgtccctgggtgggctcgaaccaccaacctttcggttaacagccgaatgcgctaaccgattgcgccacagagacaggtactgtcagttctactgggcgctataggaagggcgcacgcacgaaacttcctccctcccttgcatcctcagggcccgcccggcaggacgactgagcaaggccttggaaaaccggagagattggagcggtaagtcgcgctggtcacgttggacacctgcgcgttgggagattctggagccagaaggatagccgaatggccttcgcccgccctgcccctcgcctgcttcagaaaccccccggaaacgccccggttgagaccccggcccgagccgcctgggggccctagggaggctgaacgcccggtggctcccgggatggctcttcccgttcttcgcgccgccttcacccagtgagggagcctgtgccctccctgcccagtcgcttttggggccgctgcggagcttccgctgccatcttcggatcctgtgttccgcacgggggctccaccagggcagggatagtggtgagggtggctcgtgggtccccctcgcggggagcagggtctggcactcaccagggcgcaggactaggacttgtcgaatgaatccatccttttagcttttagtcctttgaagagccttgagaatggaaatcatgagagatttttccatggggaagttccttttacaaagcatttatttacgtggacttcttggcaccccgcggggcggcaacgggcagggcctccagtgccccttctgcgccgtggagccgcgggggctcagctgggcggtggtcgggtcctgaggccggagggcgggagcaggggaggggaaaagcaaaagcggggaaagaagccggggagcggtggaccagacgtccagacctcctgaaaggctggcggggaggcacaggcgggatcttccggaggtgagaatttttttttattatagcagaatggggaggaattgaggggaaaatggagatagaacctgaaagagccccaaacgccagaacctgtagctccccaagaataagatcttccagaagaactagacccaaaactagccgttggggaacaccgaaatccttggaggagcaacatccgcatgaccctctgtgttcctttaggcaaaaggacttgcttccattgtttgttcaattgtttgtgtttgttaaataaataaaacgattttcatgtatctttgaaattactttggcgctactattttatgattgcaaataattcggcagtgatcattcttgtacacttctcattggccatttgtgtatttctatagggtagaggcctggagagcagttgctccagcatagggattacacagtttttgtttgtttgtttgtttgtttatttatttatttatttatttttgagacagagtctcgctctgtcacccaggctggagtgcagtggcgccatctcagctctcactgcaacctccgcctcccgggttcaagcgaatctcctgcttcagcctcccaagtagctgagattacaggtccgcgcgagccaccacatcgggctaatttttgtatttttagtagagacggggtttcaccattttggccaggcaggtctcaaactcctgacctcaagtgatctgcctgccttggcctctcaaagtgctgggattacaggcatgagccaccgcacccagcgattacatgttttttttttatatatcattctattttctttccttatttggcttattagctgtaactctttcttttgttatgtcagtgatggctttagggtccctaaatacatctttatccgtctgccatcaagtgacattatacctccccttctggcctttatgctagtgttgtcagggaatttgattttggacatgttataaaccccaacatccaagtacgtacatagcgattttcagtcgtctccatttctttgtgtaggttcagatttctgtttggtatccttatccttaggcctggaggactcctttaatatttcttgtagtgtggttcggtgaattctgtcatttttttgtatgtctttaaatgtcctgatttcagtcacatttttgaaagatatttcaatttggcatagaattctagaataactttttttctctcagtactttaggatgttgccactttgacactttgtcattgacatatctttcctgtttttgtaaacttggcataaagtgggtttcctgtacttgttatatgatttttggattgtgtattcaaattaaaagtattaaattaaaattaaaatggcctgggcgaggtggctcacacctgtaatcccagcactttgggaaggggaggcagaggatcgcttgagacccagagttggagaccaccctgggcaagatagcaagaccctgtgtgtgtgtgtgtgtgtgtatacacataaatatgtatatatattatatgtatgtatgtatatataagtcctacagtcaccttaagttccaccaacagtgcacttaaagtaaaatgtgcccaacctgaggctcaaacctacctgctggcacgcaatttgtgtttgtgagacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttcctcactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttgatctacttccaactctccctttctatttatttatttatttatttatttatttatttatttatttgagacagagtcttgctgtgttgcccaggctagagtgcagcggggcagtctcagctcactgcaacctccgcctcctgggttctagagattctcctgcctcagcctcctgagtagctgggattacaggcgcctgtcaccgcgcccggctacttgttgtatttttagtagagacagggtttcaccatcttggacaggctggtctcgaactcgtgacctcgtgatccacccacctcggcctcccaaagtgctgggattacaggcgtgagccaccgcatctggccctccctttctatttcttcaagacctttttcggatccctcctgcgcaggacctaaacgggcggtgcccttacccactggtccctccctgcctggtgtcttcggagccctagctcacccggaacgttactgcccgccggtgacagcgagaggaccaaagaggaccaaagagggcagcgggtgtggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatcccgcctttatcaggagattcctttgccaaagttcagagacctgggtttcccgctgcttgccacacagaaaaccgatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacacggtgaaaccccgtctctactagaaatacgaaaagaaattagccgggcgtggtggcgggcgcctgtagtcccagctactcgggaggatgaggcaggagaatggcgtgaacccgggaggcggagcttgcagtgagccaagatagcgccactgcactccagcctgggaggcagagggagactctgtctcaaaaagaaaaaaaaaaaaaagaaagaaaagaaagaaaacaggaactagggaggggcaaggaagcaatcaggatgaatgaggggtccggcgtctcattgtctgggtgactttcagttctttgatatcttttttgagaggcctgaaggaaggaactgaaataaaacaaatatcgagtttcaaactttcagatcagaagggtccatttctatgtttatccaaaaatctacgtatgggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggagtttgagaccagcctgaccaacatggtgaaacctcgtctctaataaaaatacaaaaattagccggacgtcatggcgggcacctgcagtcccagctactagggaggccgaggcaggagaattgcttgaacccgggagatggaggttttaatgagccgaaattgcgccactgccctctagcccgggcaacagaccgagacaccttctcaagcaaaaataaaaacaaaaagctgcaggtggaaaaaaaaaagtctggattttggttcagagtccctggggccttcctcagtagttttctctttccttaaaaaaggaagcttgtctcagtctctgcatctctctgagtccttttggagattgaggatggtgaggtctcagtgcttggcccccttctaactctgggtacctcccctcccgtgggtcaacctggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctctggtggaggaactgacacccgctggagaaagtgtggagggaagcgagggctgcacctgcacgcaggagctgaggcaagcggcggttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagacttagcagggtattccgccaagacataggttagactgcggttctgatctgcaggcctcgatgccctgcgccggggcaccagggcacgggcaaagccctccccctacacaaagcaagggtgttatgcctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaactgctacgaaaaaagaaaaagaaaggaaagagaaagaaaagaaaataaaaaaaaaaagagaaaaaactagccgggtgtggtggcgtgcggttgtcctactcgggagcctgagatgggaagatcgcgccagttctccagcctggacggtacagcgagacttgtcttagggagggggggaaaaaacaacaaaaaaaacagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccatccaacagagactgaaattcgcctcccaagagagtaagtggatagttctaagctgtccccaaacatggcctcacaaaggaaaactaaccgttgcgaacggaaacaactgaccggacagaacacagccacaaaacacgagcccgcaccctgagttacaaaaacacttacggctcacctactattcgcaccacagaagcaccaggggaaaacgcgaacacagtcccctactatcacaagttatgcagtcgagttcctcacattgggggaaaatggcaggggtcagtacacccggaacataacggataagcctcgccctgagaaaaccaccttcgtgatcatggtatctcccccgccaagtaagtatgagcttttgcacctccgccccgccacagcctcacacgcttcaccctttacacgcacggtcacttgccccgcgcacgccccccccccaccccccccgcccccagccctcctagccctgacacacagctgggactctcaggtccgaccagcggtcctgaacccgctcccacggcacgggaactccttagtggcgaagcagcagcccctgcgctgcctcatctacatagaaatcgccctatccgtgatgtcaccgacagcgcctttcccagacaccgtctgctcttccgccccaccctccgccgactcagccgatcaaaccgctgccggagctggcggaggaagtgacgtctgtctctttctccttttcctcctgccattgtcctttggggaggtgcgcagagatcccacgtctggtctccccctaagactgtggtacttgatctgtgtcctgcagagaacccttctggcggccaacaggaagcttgtgcacccttcttcagataatgtcttttaatgcgcagacttgaacgtttaggattacaaggaaaaccggttcctttcaaacctgtttatctttgtgatgtagcattccgtttcaagttgaaagccattcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatgttagtattttatattctccaaagacacaaaaataatcccaatttgacaaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagaatgtagcaactgaacactaaatgcttgatccaggtgccattcctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcccaactgacattacaacagcgatctcaagactttttgtagcaataagacaccaaactccaggctgactctagtgtagcattacatgacagatagcaggccctgaaagaaatgaaaatattttaccctaaaatacattttttatcatattttgaaatgtccctacaaagttgtctcttgtggggaaagtctacatgctatagggaatccctttccaggccttttccctaatctaggcacctttttaagtctgataagaaacatttacaatcaattctctctgaagcctgttacctggaggcttcatctgcatcataagaacaaccccttaacacagagactgccttctatggattccaggtctttagataaactctttcaaccaattgccagtcaaagtatcagaaaataacggctggtaactatgtaattatgcatatatatgagtagaattttgggggtggacacagtggctcatgcctgtaatcccagcactccctcaggaggctggcagattgcctgagtccaggagtttgagaccagcctgggaaacatggtgaaaccccatctctacaaaaaaaaaaaaaaaaaaaaattagccaggcatggtggtgagcacctgtggtcccagctactcaggaggctgaggtgggagggttacttgagcctgggaggtgaaggttgcagtgacccaagcttgcaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcattcagtcttggctctggtgggaaacaaggggcacactcggatgtgtgatttaaagagagttgtgtgttttttttttttttttttttttgagatggagtctcgctctgccgcccaggctggagtgcagtggtgccatctcggctcactgcaagctccgcctcccgggttcacgccattctcctgcctcagcctcccgagtagctgggactacaggcgcccgccaccacacccggttaattttttgtatttttagtagagagcgggtttcaccacgttggccaggatggtctcgatctcttgacctcccaaagtgctgggattacaggcgtgagccaccgcgcccggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagttctgtccagtgatcctccccaagacaaccgttctctctagtaactatggttttcctttctcatttcaattgccacctcaattgactgaaatgtgaacaccaactcccgcacttaaacgttgaagccctaacacctactgtgatgatttatgcagctggggcctttgagaggtaatcaggattaaaagaggttatgagagtggtgtcctcatgctgagattaatgccattacaagaagacagacactagaaagcttgcttgtccgccttccccctggtgcacgaagaaatggtcacatgggcacacagtgaatctacagccacttacaggccataggaagagaccttagaaagaaatccgctttgctaccacctttatcttggacttcccaacttccagaagtgtgagaaatacatttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtgcccttgggtataaatccaacttcttcattttaatggtgagaaaccaaaagcccacgtttcctgatttctggcccagcactggaactgttttcatggcacgtcaattcatcatacattttaatagtgatattttatatttgcataattttattgcctttgcaatgggctttcacatctatcttctcatgtgtatatagtttagaggccatttttacccactatctcctaatcatatcgaccacagcctcaggaaatgtctgctctattatttcacttgcctgtctgggttcttgggcaacagcatagaatcctgcactgtgttttccctcacgctttctcactctttgcagaacaaatttttgttacatgccttattatcatggtaatattggccttcagtcctgtatagaagcattaaaaatgtgcgtaatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacgttatctttctgtagtgctctagcattttctaagcattttcacacactgttatctctttttttctttctccttctagaaattaattatgacttttcctttcaaaaatgaaggacttttttttttttttttactcttttcattttttcctgagaccatatgtcaaagggaatgtgaggaacaactttggtgtggtaatagccaaattcctccaggtctgctcctcaagcttgcaaagtcaagactggcagaagtggtgatttttacctgggtatcctgagaaacttgcacagtccttatcacatgcaggtgttcagagtgtgcaaataaacgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatcccctatacagtcctgtagggaggcaagaaaacttacaaacgaagtggtaaagaaagagagagattaagcaatttgccccaaatctcataaccactaggtgataagtcttcaactagaactcaaatatctgactgagaattcagtgcttttttcatttaaatcacattgcttcataaaaatagatctgcaggaagaataaaaatgtccaaagtgcaatgagacagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatggctttaatctcttatttattttgactgttgagattttgtagccattatccaaataaaacatttattttcactcgtgagtccctaatccttcgtcaatggaattagctatttatttgatgcaatagctagaccagtagggttaaaaatgcttttataaagacattaatagctgggtatggtgatgtgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaacggaaactagaaatcattgccatcagctttctctaatgtgtacttgatccttttctccctgtgatggaagtcgaaagtctttttgtttttttcttaatccactactgttcaaatgagaataaacagccaaatgactgaattagttggtagacataattcctagtcttcaattatttttatattcttttgtaatacagtcattattttttcagacttctataatattgcatttaaccaatccccaaatagggaaacgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctacccagatagagagaagtcaggcagggctgtgctgtgaaaatattagagaagcttgatgggaggcctaatatagtttgtctttacacctgtatattttgcttcttgcatctgcttcaatgccctctgtcatttattataactagatatattgttctaatagatttgtactacagtcagaacaaacaaatcactggatccagcagaagccttagatatatgacataacagagatttgcacaaagatttgccccattgccttctcaaatttctcttatcatcaatccatctagctggagctctctgaaggtcatcagaggtcagtataattttaataagattttaactgaaggctagccttgatgttcagtgaccttcagacatgtttataatcgagaagccactccccctgttgaatgataacctcttccatgaattaccaaaccaatggtgctcacattctgattaacgattgattcccataaacccagcttcccccaacactgatgatctaaataacctgaattatttgcattgccttatcaattccatctcatttcctgtcttggtggttttgctcacactgcttctatgtggaatgtccgtatgtagccacttgagtttccacttcatcgttccatcatctgtagtctctatacactatccatcatcaggactaatgtgagctgactttcctccaaaaagctttccctgaacttatcctgaaataacgtttttctctgctaacttagcatttgtcacgttagtatacagcttctctaactgtcatgaaatgaaataaatgggaagaagatgaaacatgaaaagaaatctgctccttaaggcaggccctgggggaatagccctggctggaggtaatgtaaggtctagatggtgtttttagaatctgaagactgcaacaccaaacacaacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaatggctaagaaatagtaaaattaacacatggcctaaaatattaagaaattatgcctgttacagaattacggacctggctagtatataggagcattaacaacacaaaaacagattaggtcgggattagcagtgggggtgaaataatcttcagggctgaactactgagctagaaatatttaaatcctccttgcagatgaaaactatagaggacaatttattggttcagcatgaatttctggtcttctgttaagaaatacgctctttcattgaaagtgaacattgaggcagtaaactccaaatacagctgcaggtactatctcctgctgatttgtgtgtatagagcatgaaagaaaggctcagaaacaaaagcatgttggaaaaataagcagaaggagacatttacttgcaaagaaatgtgaggaagtcattcttcaaaagaactgcccaaaaaattaaaaaaatagaactttttaagacaaacaatattatgaagacaatagggcttatattaatctcttcatggcagaaaacagcaattttatcatggttattgtattcagaaagttcatgacatatcttcagacaataaacagcattgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaacgggccgacaatggtgtcaggccccgatgtcactttggtttttacacttcatcttgcggtcatgtttccttctctacaggacatgtttgtctacctccatttgctgaacaatgttcctaatcagtactattgattttacattttaatttgatccattttatttgcacagatctaagaagtgttgattaatatttaatgacctcctagtatttttttgatgaaacaataaactaaggctcacaagtttacgtctatctatagatttataaagcccttgtgctttaaatttacttttacatgtttaacagctcagtttagagcagaccaaaccagtccgttcacctctacctgatttcatctgcagtatttataatgcaaatgtatcctttttaataaaagttatccaatgtctcggtgtccctgctctgccaagaaaggacattctttcttacctccaagcctgagattgcatagtccatagagcaagcaccagattggtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctgatgcctgtaatcccagcattttgaaaggctgaggccggcagatcacctgaggtcaggagtttaagaccagccaggccaacatggtgaaaccccgtctctataaaaacacaaatagtagcctagcatgatggtgggtgcctgtaatcccagctacctgggaggctgaggtgggagaagtgcttgagcccaagattgagaggttgcagtgagttgagatcacgccattgcactccagcctgggcaacagagcaagactccatctcaaaaaaaaaaaaaaaaaaaatttctaatcagtaatatattcaggtagaagggaggacaaattcttattgaaccaatacaaataactacatagtcacataaagtaaatgtttttattaaagaaactttgtgcaagatttaagcaatattgctaattaagtgtatgttaatagacaaaaccaaatattgtatgtcacaattctttacaaaataattatttgtatgtttttcttggcaacttattagctttgtttttatattaagaatttctgcaaggtatttttttcctcaacactaagaattcagagtgttttatttagtttttacaaatttaataatttgtacatttaattggagattaaaggtagattaagaagaaagaaaatgggtttctctcatgttcattaaagtagaaaattaaactagcctcaattaaattgccttactgaggccctttaatcctaaataacaacctcttgtcgtgctggtcttgagttaagcagtctactttcatgaattcatcggcttctacactgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatacttcttccagatgactcaaattctgattggcgctttgtagagaggcttttaggtatgcttaaagggaaaggagggctaggcacagtggctcatgtctgtaatcccaacactttaggaggctgaggcaggcagatcacttgaggtccggagtttgagaccagcctggccaacatggtgaaaccctgtgtctactgaaaatagaaaaattagccatgcatggtggcgggcacctgaatatagctactcgggaggctgaggtaggaggacagcttgaacctgagaggtagagtttgcagtgagctgaggtcataccactgcactccagcctgggcaacagagcgagattccatctaaaaaaaaaaaaaaaaaaagcagcggggatagggggaggagatgttgctaataataaaactgtaaagtttggttaattttttgccatagcaaacaacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagcaaattaaatatctggagaatgcaaaacattacctttatttctaatatatcttcatgttaagagctaggaggaggatctctggagtttcccagcagccatctgagaaacccagagatactgtattcataagtaacatctcagtagttttactattttggatttgagggttaaatttggggaatatggtatcaaaaacagtgtcacaggtgggggctgcagatgtgaagggcctgctatcaatcaggtgaccctggatggactacccactccctgtgtcagtccaggatcccagctgtagtgggttcctctctgctacagcacatgtttctaaagggcaagaatctgggctcccaataactgacctctgtctcctccatcctggcttgtcatggtagacccgaaccaccctcccattgaatttgggcccttgtggctcatagccacaagggaaattgggagctcacatgtgaaaggcagaattaagttaatgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggaacaagaaagacaacatgacttctggaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctgtattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgttgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcacctgtaatcccagctactcaggaggctgaggcaggagaatcactggaacccaggaggcagaggctgcagtgagccaagatggcgccattgcactccagcctgagggacaagagcaagactttgtctcaaaaaaaaaaaaaaggctaatatatggagattgatttatcattttatcaaaaaggtaacccaaacactaatatgacttttttgagaccatccatttaacaaattggactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagactcatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccatgtagggtatgtgtggttttacctatacagtataattatttgtagccccatctcaagttacaggaacaaatgttttaaaaaatactagtttaataattcaattcagctgagccataaatccagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttaaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaattcattaattttctccagagataggaaaatgtacaataatttgttcagaagatatttacatacatacaacaagaagtcattatgaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctatcaacagttagagctctccatttttcaagctatgcaagattgtctccaatagttatggcttcagcagtggttcagcttgagtgtgcatcagaaccacctgcaaagcctaattaaacggattccttggctcacttggcagtatatgactcagtaggtaagatttgagaatttgcatatctaacaagttgtcgggtaatactgataccgatgtctagggactatgagaatcactaacctagagtgtttaaaaaatgaccaatttctgtgcccaattatctgccaaagtttcctaagagaaggaaaacaacaacaacaaacaaacaaacaaaccaaaacagagagaaactgagagaaacagccacaactggaaactagtaacacaaaaacaaaccattgtaaaggctaattaacttattttcataccaatggggaaagatttttatttcattttgcactcacaaaaagctttaggagttttttcatgtgccagaaggaagcacataacctccaaattcacaatctattctttgcccgtttgctgtagttactctttgtaccaaaggttctgagtctggagtctctgcttccactggtcagatagactctctccttacattgtggtctctcactgaatgttctcacccactgcttcctcactacgtaatatctgcccaagaagctccccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatacaaggtaagatcaacatttgaagtgattgagtttaaacataaaaagatgtattggctcctgcgactgggcagtcttcagggttagttgcttgagtgatcaacgataccattaagattatgattgggacatgaaaaaaagaactggcaaataaggagagaactttgacaatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactgagaataatcatcacaccattctgtctcacattctagaaggctttgtagtggtagaactgtaaacaacatataaacatttctgaaatattgtggttgttttatcttccataaacctcacacaagccgtgtgtatgatcatccatcttctgggccattatctgattattgctgctatctctcgctttggggaaaggaggtccctttccttatcaatactattggatcagctcttctaatttcatgatgacatgagtgttcaggaatgatggaaggcaaatgtaactctgagaaaacttggtttaactactgcatttcacaagtccatatccatcctagaaggtcttccagcctgctctctgccttgctcccaagatggccacatgtaggtctcttctttcccgtaaccagagggttatagattatattatccttcaaagtctgggataaaccaatttctcactctaaagagaacaacgtgttttgatttttccaaccctaaccctagcctaaagtctaccttctaatcctatcttattacaaatgtccctggattgatctttcaagggatttttgcctactgaaaaaatattactctcactcaaagaattgtggcctgacaagaaatctacaagagtcttggacacagaggccaaaacatcataacatctggattattcaggataaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatttctacttccttgaaattttattgagaaatccatcattttccaaacttttctttctattggtgtaaaacagggatgaatggccatgagcacttcattgcctcatctcaggtgacacttctttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatggtttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaggaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtattttttttaaaaaaaaaatatatcagaaaaagttttggagaattgcaattgaaaaaactagcagactaactgcatagcctagaatataaaaaaaaaaattaagaaaaagctatgtacatcctgaatgcataaagtatatgtatatattaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaacaatagcacatactgtactacccaaataattacttttattttatttttataaatgtgctaggtacaagcatacttttattatatgattgttttgttatttggatatattgctagtggtgaagtctgaggttttactgtactcatcaccccaatagtgaacattgtacccaataatcatttttcaaccctcactcccctccaaccctggcatcttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctctcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaagagaaattcataaggcctcatttcatgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatgacagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccaggcagaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcctggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacctcagcctctagataagggagtcataaggacctttaaggctctacatatggcactctatggaaaggtttgtcaacattgcaaaagagaaacccaatagagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagaactaatacacaccacaccagaggaattaacaaaagatgacttcatggagatgagtgcttcctaaccagtgccagataatgaggaagaagacataggaacagcagtgccagaaaacaaattggcattcaacaatctggcaaaagaactttgattattcaagactacttttgacttcttttatgacatagaccgttccatgatacaggaactgaaactgaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaacacaacaatgatgaagacctttaggatgatccacttccacttaatgaatgggtcatatattttctcttccttacaattttcttgactataatttcttttctgtagcttagtttattgtaagaatacagtatataatacacatagcatgcaaaatatgtcttaaatgtaacgcatgttatcagtaagccttctggtcaacaataggttattagtagtttggggggaatcaaaatttgtatgcagatttttcactgtgtgggaggccagctcccctaaccctatattgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcatccctgaatccttatcagcaatgaatttttaaatatactataagagatgaaaaaatttttttaaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttaaagaaaagagtctataagacaaaggtcctcataaattaagagaagccaagacagtcactgtgactgcagaatattttaatttttttttattatactttaagttctagggtacatgtgaacaacgtgcaggtttgttacatatgtatacatgtgccatgttggtgtgctgcacccattaactcatcttttacattaggtatatctcctaatgctatccctcccccagccccccaccacagagcaggccccagtgtgtgatgttccctttcctgtatccatgtgttctcattgttcaattcccacctgtgagtgagaacatgcggtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctatcactgatggacatttgggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcgtttctctgacggccagtgatgattgatgatgagcattttttcatgtgtctgttggctgcataaatgtcttcttttgagaagtgtctgttcatatacttcacccacttgttgttggggttgtttgttttttcttgtaaatttgtttgagttcattgtagattctggatattagccctttgtcagatgagtagattgcaaaaatgttctcccattctgtaggctgcctgttcatgctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtataaggtgtaaggaagggacccagtttcagctttctacatatggctagccagttttcccagcaccatttattaaacagggaatcctttccccatttcttgcttttgtcaggtttgtcaaagatcagatggttgtagatgtgtggtgttatttctgagggctctgttctgttccattggtctatatctctgttttggtacaagtaccatgctgttttggttattgtagcctcatagtctagtttgaagtcaggtagcgtgatgcctccagctttgttctttttgcttaggattgacttggcaatgcgggctcttttttgtttccgtgtgaactttaaagtagtttttttccaattctgtaaagaaagtcattggtagcttgatgtggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcatttttaaatcctttcagcacagagacaatcaactgactgtctgggtactacctgaccactattggagtctctttcatctgcctgagtctgtgcaacaatatgaaattataattttactatgcacctaaacgttcctcaatatattgaattcttacagaatttgaagagtcaaattttgtaaatccagttacctttttccactactctaggcctcatatactatctggcctaagggttaaaggtccacaattgaataagccaaacttgttaatttgaaggtaaagcatgtcaagaaatctggccttaatgtccaatgaacttatgtcatattaagtagctggatagaaacatgcattccaaagtggatactgtttatcaggctcagtgtgctctattcttgacggtaaatcccagaatagggtggatgctttaattttgtattaaatagtattaggtgtaatatcaaaaccactaagggaacactaatgatgagaataggaacactagctgtggagctggcaactttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtcttccaatgtgttttcatacattttctttctgggatcttgagtgaaacatgtggatctagaacaagaacaaaatgatgttaccttgatgatctctatgtagggtcacactcaaggcatcttaaaatattttgctggccaacaaaagacacctcctgttctaattgggcattgtccttttctttaaactatgcagacaaacaatattataaagtgagaacatccgcataaaaaacctaaacataaatcttaatagtgagttcatgaaaattcttactgatgaaatggcaatgtcacagactgactgtttatgtccccccaaatttgtatattgaaatcctaacccccaagctactcgtgttaggagatagagccttggggaggtgattaggtcatgaggacaagattctcatgaatggaatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccgtttactcactgttcctctttattttagtttcacatttttgctatttatctctgtaattttattcattcttcacaatttgccattcttatacttcgaatcatgttatcagtttataatacctccatcaaatgatagtctgcatttgtttatccttggctgattcaaaacacttggcataatttccttaaaggaaatcatcttcatcccacctcacaacactgtattattttcaattaatttccaataaactcttaattgtccatgctctgtcagagttggcagagttaatccctgtttaagctaataggttcaacttcttcaacaaacaaatctttcatgaaagctgctgacaagccagagtattaattaaatctagtttcattgcttctcactttccttgatccttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcgagtacagtatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttattcatttaaacagcaaggtacatttcattctacagatatactatataatatttactccgatctctggatgagaatttatgttgcctgtaaatattgtatcacaaacattataagaataatctctgtaaaggttttcttcctgaattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacaaataatgcaatattatacaagggagattaataggtagaaaaagaaatgcaatggccaggagtaacagaagatgttcaacatcaatccaatcaaattaatgcgtctttaaaatgcaatagcagtcaatgttagcaagagtgtaggtattagacattctcataggaatataaactaaggccatgttttaggatcatattagatcgcagcaattaaaaaatgttaaattcatatgttgtatagcaacttctcaggttggaatttatcacatggagaatcttgtaaaatacataaaccaagatatgttattaatgttattggtagcctattgttttaataaaaaatatatttatacaatacagttgttaaaagttaagaatatcttgaaggtaaattattaaacaaaaatagaaagcctaggccaggcaagacttcatctcatgcttataatcccaacacttttggagactgaggcgggaggattgcttgagcccaggagtttgagaccaacctgggcaacacagtgagacctcatctctagaaaaaaaaaaatacaaagcctagttctgaacatccttttgtgtaatactaaaagataaaattttattttctatcttgtttaagatctatattctatacgggggatgtgtattaaggtcatttttaaaaagatactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccatggttattaatcagtctcactgactacattttctgttttacatcccctttcaggcactactgcagatggccaagcatatcacattatgtaaataaaataaaacaaaatcttttcccattgagcaaatggatatacttcacctctaatgcttccagtctttctcagatcattcaaaaagcatgatatggtttccatgaaaggacattcatcccatttgactaactggaatttctttactccagctaatctttaccaaagagctgaattaattcaagttgacaccctgttatctaccagctcttccagcccttttgcttgattgttttgtcattttgccttttcttttcttctaaagtgggagtatggagatttacccttctgaaacagctgtgtcacatcatgatccttgagaatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggggcccagtgggagataactgaatcatgaggatgggtctttcctgtgctgttcttgggttagtgagtaagtctcatgagatctgatcatttttaaaatgggagtttccctgcacaagctgtctctttgcctgctgccatccatgtaagatgtgacttgctcctctttgtcctccaccatgattgtgaggcctccccacccatgtggaactgtaagtccattaaacctctttcttttgtaaattgcccggtctcaggtatgtctttatcagcagcatgaaaacagatgaatacaacaatactgtaacaaatcgactcacatctgttctctttataggaattgcagtgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcatggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaaaaaagaaaaagaaaggagaaagaaaggaagaagaggaaggaaggaaggaaggaaggaaaagaagaaagaaagaagaaagaaaggaacaaagaaagaaagaaagaagagaaaaagagagagaggaagaaagaaagagagaaagaaagaaaagaaaaaggaaggaaagaaaggaagaaagaaagaaaaagagagaaagaagaaagaagaaaaggaaagaaagaaagagagagagaaagaaggaaaagaacgaaaattcaagtcctgccttgtaaaatgcagtactccattttcccaaagagatcccaagggaaacttaactacaggataaagacagacaaaaggacataaattacaactactctaggttcacatattattttgtttctgaaatgggttttaaaatatctatgtcagagttcatttctagaactttatctctagaaaacatattttcacttctcaatacaggaaaatggagattggaaaaatgagtttggaaaatgatttccatgcttatctctcagcttcttttttcaacttccctttttcatctccgtatcttcactgatacctaggaatctctgttacatcacagtcttcaagagctttgctcacagcgaattagttaagacattagctttcaaaagtatatgatattctctcacaagcatttgtctacttttaatagggcaagctacgtaaagatgttaaatctcattccagaaataccacatctattctacctatttatgagaacagtcgtctctagaccaagatagaaattcatagttaggaaataaatccctgtagggtttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaatgttattttactgaattactcattgctgttttctcattttttaaataataaacacttattaagaaacattggaaatataccaaaaatagtaaacaataaaacagaaaccattggcagaaatagtcactattaaaatcttaatatactcccttccaatgttgtttctgttaatgcaaattaaaaaatcagagattcgcctctgtgaactagatctctttttacctttagatattatttgacaaatacatagctcaatcatctatccaaacttctcttttacagactccatgccaattaaccttctcctatgaaactattatttcttcacataggataaatatggttattgacacacaaactttcttagttacactgcaatccagttgtgcgttcctaaatttataccaattggatttagaatgatcattactaaagaggcttggccttatctcttgcaatttgcttcttccttcttaaattcaattcttgtaatgtaactataatttgggggtatctttttgcctcatattcaaattctctttcaaactgaggtacatttctgtatttctgtatttgtatattgcatataatagtatagaaaacaataatgagattatagtgtacataaaagttttgaagtataattaaatatttaatatataaatatattaaatatgggctgctgactcaccaagcctggtttggcttccatcacttgtgtaatcaatcacctgtattaaatcacctctgcttgaaagatgaagaatagtttctgatttataagcaaacactgaaagctcttctatttcttgtttgctaaacaagatttgtcaaagttaaatattttattttattgaattcactttttgcctctcctacaatgatgatttgcttttcctcctttaacttgttaatgtgatgaattatacatagtttttttttctattgttagaaatccttgcattcatggaacaaacacaattttcatactatattttttatagacttctaaacttaatttgctaacttttaatttaaaatgtttgccgttaggttcatgaggaaagttggcatgtaattttcctgtcttacacatttctcatataacattggtatcaaggttgtactggcctcataaaatgaacgaacaaatggacctttttttattctggagttgtttttataaaatggaaataatccatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgacgaaaagccctcagatattaaatataaccttaaatataaccttcccccaattcaatttttcttttgcagatatgattagatactctaatttttcaacctctatttcacatatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaaattcagtttcaatctgcttaatataagatacatacactgtctcaatttatattcctggcacacctcattgattttttaaacatattaaacacagcttttatagttatataatcgtcctaatatctgaaatctttatgggcataattctgtttctgctcatgatgtttatttcctcatgagttttgtaagagtcttacatttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggttttttttaacttatacttacagtgaaaatttaaaccacaaattcatgtgaagatggccttctcatttttcctctaaatagcaccgagtttgaggcaggaaaatttcctggttgtctccccctgaggaacaggtttttatctagtttatcctttcactgaaattatagtccttcgtatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttagtttctattcaagtcagtaatatacttttgaaaaatgacatgtacattttatctggtatttgtagatttcatatagcaggatagtgattcagcaaatttagtctaccacaatgctgggaatagaattcccctaatttttgaaaacattatattaaatcatgtttattgccattaatagtcttataaatgtgcttttaactaactgcattttgtcatagctcattgtgattgtatatttaactagttcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctgcaaatctgacaaagatgtgagaaggcatcttatagtttcaatttgtatttctttggtgaccaatgtactaaattactcaatgtactaaattactcttttcctgtttatgatccatttcaaacaaaatgtaaaccattttttaaatttttttatattaatgcaaatcgtaaatcactactttatttattcaacttcctaagcaaaattatatgttgtcccatttatacattttatattagatctttctgccttacatttataacctaaaaaatgtcagaattatataataatgatgaacagttgattataaataatgtctttattaggatatttctccataaatctaaatttcatcaatctttctttaaatatctctacacaatgtcctcttgtattatattaataattgcagatacacttctttttgctatttctattctttcctattcctattgtctgttagtctcccattttctcccataaaataaataaaaatttttctatcagattctgtgatatattacttcttattcccagccttcaacattttaagaattcatattgaccttttctcccattcttatttcaagttatcagcatgttgatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataatgataccaattcaagaaggagaaaattgatgtactgataaacaaatgggcatcttaggatcatgtttctcacaagtaaggcagttccagaaattcctaggaccataatgggttttattctaaataggttaaacatatcacttaaaaaattgttttctacagttctctaatattgcttacaattgtccacgtttccatgtttataaacttgcacttttttttttttatggagttttgctgttgttgcccaggctggagtgtagtggcgtgatcttggctcactgcaacctccacctcccaggttcaagcaattcttctgcctcagccttctgagtagctgggattacaggtgcgtgccaccacacctggctaattttttgtagttttagtagagacggggtttcaccatgttggccaggctggtctcgaactcctgacctcaggtgatccacccgccttggcctcccaaagtgctgggattacaggcatgagccactgctcccggccttatacttgcacactttttaattctaagaccttgctactcagtgagggatcctgggactaataccatcagcttgacttgaggccctctttgaaagccgactcagaatctgtaatttatcaggatccccaggtaatttgtatgtgcagtctagtttggtagatctgctctggcagactggaagactcttctatctgcctcatgtaaggtgcaggtgacataattaggtaatcaagcaaaagatcacatattttaataagaaagagacactggctattattttgagtggtaaaacaggttattcagtcccagtttaaaatggaaatgacagagaccaagatgaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacgccagctaacaaaacatgctatccaggctctttcgtttcaccatattgctttcttgaaaacataggacagtgccagtttagcactgaaaaaaatcagttctcctaattctaaaaagaggagacagccaggcgtggtgggtcactaaaaatacaaaaaattagctgggcatggtggtgcatgcctgtaatcccagctacttgggaggctgaggcaaaagaatcacttaaacccgggaggtgaaggttgcagtgtgctgagatagcgccattgcactctcgcctgggcaacaagagcgaaactccgtctcaagaaaaaaaaaaaagagagagagagagaaactgtaatttcatttcagaagttttatagggtagtatttccaattctttttttcttactccattaaagtgtaattagcagtatgtgaaaatttccactttatcctcaatcagaagcctctccttccaattagcatatattttttctattaactttgtaaagtgggattcttgttttatacatacccctggaaagtatacttaaactgtgagaccctgggattttatatttccaaatagaagataccatcctcttgtatcacaaaatgtacctaagatggtttggattatatttaaatattcttgaatgaaatagacttactgactgaagccaattattatatttttccacaccaaaataaatgcaataggaaaagatgacagttctatgtagtattcctgcttccatattgcacaaattagaaacatacatattccattatgttacagggtctagggctttgggaggacaaggctgcaggcagccgagattgtgccgctgcactccagcctgggcgacagagtgagatcttttctcaataataataataaaagtaaaaagaaatataatatttaatcaatatatgcacacacatgggtttatcatgacacacatgacatgtgtgtacagtgaaaaaaatgagtaaatctagaaacctgtattgcctcaatagctagctaagtacttcaatatgcatgtttatttcaacaattttgtgttaagcttcagtggtaaataagcagagtacactgaccataatgaatacttcttttgatgagggttatcactacacaattaaaatattacatagttggctgggcacgttggctcacacccataatcccagcactttgggaggccgaggcaggcagatcacctgaggatgggagttcaataccagcctgactaacatggagaaaccccttctctattaaaaatacaaaattaaccaggcgtggtggcacatgcctgtaatcccagctactcaggacgctgaggcaggagaatcacttgaacctgggaggcagaggttgtggtgagccgagatagcgccattgcactccagcctgggcaacaaaagcaaaactccgtctcaaaaaaatatataataataaatatatatatattatatataatcaatataaatataatatataataaatatataatatgtattatacaaataataaatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgtttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatatgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctgataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaattttttttatttttatttttttagtttttttaagagacagagtctcgcagtgttgccaaggctggatgcagtcacgccaactcagctcactgcaaccttcgccttcagggttcaagcgattctgctgcctcagcctcccaagtagctgggactgcaggagggcaccacgatgccccactaatttttgtatttttagtagagatgtggtttcaccatattggccaggctggtcttgaactcctgatctcatgatccgcccacctcagcttccctaagtgctgggattacaggcgtgagccaccgcgtctggctgcatgaccttttaacttgtctcatacactcaatattctcaagatataccttccaaagtgcaaaattatggcactttgcagccctgaccactaactgagaactttgatgctttggattttggagacctcattttatcacctggtccttttacttcatgacttgtcatgctgccaccttttgatgggattgagatgaagataataattcccaactggtcaggaatattgtgcccctttgtttttatatccagatgcaatagagcctctgacacaccactactattgttcttaggatttggaacaaaatgcatttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcagcagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggctcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagcgaaactctgtctcaaaaaaaaaaaaaaaaaaaagaaaagaaaagataattagggactcggaaagacaaagactgaaggattggtggcaatgagttttggggaaaaaatatgtagatgaaccacagaaaatgagccagagtgtaagaatatttgtgcttaatacgaatgctcaccaaactatcatcaggaaggttatcaaatagatatgaaggtatgaaacaatctctttcaccaggcactacattgcttgcttagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttattggaactcctctatgataaaggcaacaaggaattttgtaaatggaatctacctttaaccttgaattacatttgctttacctgacatcatttttctctgatcgccactctccacgggtacattgaatgccttatatatattgccataatatcctgttctacatccttctcttaaaagaacttgttgtataacaaatgagtagatattcattggactcacctggtccaccatttatcctatcactaaccaaaattattattattacagaatggtgaatattttattaaagactcaatcacagtgccagctggagacaatggcttataaggttgtactcatgctagaggatgtggtggtgtatcctctgaactagtaactaagtataagcttgtctggtgtctcctatataaaaaatacaacaatctttgatatttgttatgaatgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaacagtcaaaaatttaaaatttaaaatgcggctacactgtggcatggggtagtaaatcttgaccttaaaactggtatttgtaagaaaaacagaaagaattcagggatcccctttgatggctcctaattctatacagtcctgtaaatattcctgaagactaaccaggcgtggtggtgcacacctgtaatcccagctactccagaggctgaggaagagaatcacttgaacctgggaggcggaggttgcaatgagctgagattgtgccacttcactccagcctgggtgacagagcaagactctgtctcaaaaaaaaaaaaaaaaaaaaaagaagaagaaagaaagaaagaaagaaagaaagaaagaaagaaagaaagaaagaaagaaatgaagactgccacaacttggaagcaaccaagatgtccttcaataggtgactgcataagcaaactgtggtatattcctacagtggaatattattcagtgctaaaaggaaaaaactatcaagccacaaaaagatacagaaaaacaaagacattttgctaagtgaaagaagccagtctgaaaagggtacatactgtgatttcaactatacaacactctggaaaaggccaaactataaagacagtgaaaagatcagtggttatctttgcagacgccaccatcgctgtgagccctgtactatcagccatggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgcgctgccaagactgagtggttggatggcaagcatgtggcgtttggcaaggtgaaagaacgtgtgaatattgtggaagccacggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacgttggtaataatgtaatgatgggtacatgacattatgcgttttgcaaaactcctagacctgtaccacacaaagagtgaactctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatttcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaactttgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaatatttactatttgatgtttgttcctgtgtttgaggaattcctcagcctctcagttttgacgaaaacaagaaaccacctcctgctttagaagctaaaatgtcaaatgcttgctttctcagcctcctttgcagctatctgttgcaaagcgaacaagtgggagtggtgctggtggctttgcagttagcctaggattgagcaattgctgcaattgttgctctctgcatcttcggtgttacttcttactggtggtgacagtggtttcctccctggatgagttctacagcatggtttggggtacatttcctggctgcctagctttgatctggctctctagccttctcaacagttctacaagttccccactatttctgtgataaacctatttattgttaatgtcagccataattggcttctgtggtttatattttttaaaattccaagatataccaatgtaacagatagctcaacaaacatatgtctttttaaattaagatatattctgtgtcacatgaagtacaatggacaaaatgcaacaaattgaattgagctaaagaccaaatatatattaagcctggctggtcttaaaaatgtaactggatacagccaggcatggtggctcacgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgagaggttgaggcaggagaatcacttgaacctgggaggcagaggttgcagtgagcccagatcatgccaatgcactccagctttggcaacagagtgagactttgtttcaaaataaaaaaataaaaataaaaaaataaaaacgtaactggatagacctaaggatcttgaataagcagaaaataatttaggtaaaaaccaaataataaactaacattctgaaaggtttaggatttggaggcccaaatgtcttagctaaaagtgttcattctaacctcacaggaaaattgaaatatgaaaatatacagaaaaatcttaggcagtatttatcaattttaagaaacaactatttacaggtttttcaataggcattacattaaaaacaaaatatatagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagtttttttcatttggaacacacactcattccccagtatactaggggtaataataatttaaagagtttaattactttttactactagaaaactaattttatgtttggcacaaatttctgaaatgatattccactgcaaagaataatacctatatatggccagaattacttttcttctataacattaagataatacttgtcagcctgagcaacaaagtgagacctcatctttacaaaaaatagataaattagacgggtgttgtggtgatgagggtctgtagtcccagatactcaagaggctgaggtgggaggatctcttgagcctaggaggtcgcggttgcagtgaactatgattgcaccactgcactccagcctgggtaacagagcaagatcctctctcaaaataaaaataataaaaaaaaagataatattggtataattcagggtttttgcctcaatccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattaccccaaaaatatgacctgctgaatttctgctgtcatgaattgactaacatattttgggcctaaaacctttacatttagaatctttttgtttcgtattggaaaatattgtaagtcctccatttattggtcaaaagcactgcctatttatttccatgcttaatcagagagactttccaatagttatttaatattatttacgttcattcacttgttgactatattgaggttagttgctatgatatctttaggtcattaatataataaaaatatgtcaacttttctcttccaatgtgtctttgggttattaatttttaactcaggtatcaagcttgtaaaatgtttaatggcttataataatgtctaacacatagtatccactgagttctgataactctggtttatcaaattctctttttttgtaccattctccaaatgcaatgctatttggttttatttttattttttaaaaatgtgctgcctgttttgagtctctaaaagtgtgaaatgctcagcatttcccaaatgtatttgaacatggagtgttatatttactaaaaagttaacaagcaagtattcccctaaacactctagcaaatactactagtacagacaaattatgatgtaacattatagtacattttaacttattaggttaattttggttgcaaacaatcaaaattcaaaatggcttgtataataaagagattttgaacaatagtataggctcaagatagcctaatgcagaagtttaataatgacacaaaataaatgcttcttgtcctccctgtttcttcactctaccttaagtgatatagattgaatgtttgtatcccccccaaaatttgtatgtttaaatctaatccctagtgtgatgatatttggcagtgggtcttcggggggtgattaggtcatgaggacagagccctcatgaatgggattagtgcccttataaaagagaccttagagaacttccttgccccttccaccatgtgaggacacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaacacattaggtctcagttttattctatggcttaaaatatcatgtcatgagtagacaacttccaatcctagtacctcatgcttcctctgctgcatttggaaagaaggcatttccctcttcaatcatggaatgaaaaagttgtacttcattctgatttgattagcagaaggcacaggttccttccatgcaccaattacaatgaccaagaattgggcatgggactcatgtcacttaaacattgtgaagctgagaaattcattatttggttaggagtgtgtgagagcagggaacactgaatgcttgagacaccaccacgatgtccactacatgtatttccatttcagtaaacatttccattaagataatgctagaacaaaatcagaggagtagatcttggtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacacctctacatatattttggaggcctttacacaaaagtgttttccctgaagggagaagagaaaagttgaatgcagaagtagaaaaaaaaattcatttgcacttgtagtatttatatctaaatattttatattacagatgtattaaaatttttataattttaaacactactttaaaacagggagatggtttaccttcaaaaaatttggctctcaactcaaagttatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcaaaagaaaaatagctggttttaaggaatgaagggccatgtcaactattggaagcatctttgaactggagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagatagtaaagactaatcagacacacacacatatgcacaaaaagagggagagagagaacaaaaatcctatgaaatacattttaaaaacttaatttttttaagaagaagcatttgatctgccaaagagaagagttagcagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataacttcttgtccattcttgtatgtgttatggtttctttcttagaaagaagtatgctatactagtatacatactatttattcatgaaccttgcacttatcatgtaatcatatgtcttagtggtcttttcataatagatgtctctctttcccacgctgtcagtggtgattgcatgaggcattgtacagacgtaccaataattacttactctgtgtcatattgttggttattcagattgttttcactttgcccttgcagacaacactgcaatgaacatccttatgcatatattattccaaatacatcatcgtcatggctgtgtgagagaaatatacattgttgattttatttttttattttttataatttcaacttttgattttagatacagtgggtacatgtgcaggtttgttacatgggtatgttgtgtaatgctgaggtttgcggcatgattgatccgatcactcaggtactaggcatagtagttgtttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataatggcatcgagttgcatccatgttgctgtaaaggacatgattttattcttttttatggctgcaaagtattccatgacatatatgtaccatattttctttatccaatccacagttgatgggcacctaggttgattccatgtcttagcgattgtgaattacactgctgattttaatagaaaccactaatttttatgccaaaaaaatcatcaatgtgcacatgctccaaggctgtgtgagcatagcccttttccttgggatgtcaacaacactgggttttatcaaaatataatttttgccaatttattagttaacaaatgctaactcagtgctatttggatttgaactaccactggtgctgagcaactttttacatagtcactggcaatttatttatctttctctgttgtttatctttttctgtgtaataattttccctatcttctactcttttaaacattaagttttcactgttttcttaataatttttaagtttaaaaagtgaccttttggctgggcgcagtggctcacgcctgtaatcccaacactttgggaggccaaggcgggtggatcacaaggtcaggagatcaagaccatcctgcccaacatggtgaaaccccgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactccgtctcaaaagaaaaagtgaccattttatctgctgcatataattctaatgatatttctcaattcgtttatcttttaacaatggtaatatataatgtcttgctatttagaaagatttttaaaagtattttacataaagaaatttttattctttgccattaatacttgcaggtttggaattttcaggacctcctcaaaggccacctacaggaaatgctcttcaaagacatttcactttttccccacttgattgtggagcaaagactaacactggcaatgctttgaagtacttgagtcaaatgggtctctcatgtggtcattactatactcactctcaggctccaatgcaaattgtttccttacgccaactactcttgctttcctttaatagacctattcctcctgggctgtctgaaactaacatttcattgtaaataaagtcctgcaaatccttggtatctcaaagaaccctccttccatttagttttaggagaactctccttctaaaactctattcttctccctggagtccagatccccattccttgcaacaaatgaacgcttgatttgagcactgaagggagataattggaagtttgactttgtgttctaggttttccctgccaatatatgcagcgtctttaaaactaattgggctgaggcaggagaactgcttgaacccaggaggaggaggttgcagtgagccgaaattgcaccattgaactccagcctgggtgatagagcaaggctccatctcaaaaaaaaaaaaaaaaaaacagcaaaaagaaactaattaggttcaagaagttcgaatgaattcaacttagacaagctcttaagcagacatgttggaagttccagaaaagacagtttgggaaaatattttattaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttgttttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctccccaattctcttggctttaacaataaccagatgactccagaaaactattcaaaattccggacctatggagactttgcacccagatatgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataatcctcacagtaattttatgagataagttctatttattatccctatcttaaggatgaggaaactgtggtttaaagagcttaagtaatttgggcaaatcatgaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagtttttagtgcatagcatagggcttagaaaggagaaaatgatgaaaaatatttattaaaataattgtttttctttgatagttgttataaccatctaattgtgagtgcttaacaattactataaaggagaatggaaatcacagatcttttcacagaattttttttttttttttttgagacagagtccagcttgtcacccaggctggagtgcagtggtgcgatctcagctcactgcaacctccacctcctgggtttaatcacttgccttggcctcctgagtagctgagattacaggtgtgcaccaccatgcctggctaatttttgtatttttggtagagatggggtttcaccacattggccaggctggtctcaaactcctgacctccagtgatccacccatctcagactcccaaagagctgggattataggcttgaaccaccgtgctgggcctttcttagagaatttatagtttacctggaaatgtaaactatatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagagaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaacatttaatccctggaaaaaatgatgacatcacactgaaatcttgactcataagagaacttttttatgctgttccctaagtcagtttatttctacttcattcttgcgttaagggtaggctcaattcttactcattcaaaaacggtatcacctgaagcttttctttaattcttgttttctctgcagtgagaaaattaaccaaggggttaaaatgtatattaattatatatgtattatatgtaaaagttatataatatagatcagagaagaatatattgcatatgttataggctgaattgtgtcctttccccaaattaatatgctgtaccctgccccctgccatcccagtatatcagaaggtggctatatttggagatagagacttttaagaggtaactaatgtaaaatgaggtcacatgtctgggtcctaatccaatatcactggtgtccttatttgaagaggaaatttaggtacagacatacatgtgcacagaaaaaagtccatgagaagacaagatgagaaaatgactatctaaaagccaaggagagaaatttcagaataaaattaacacatctgatgccttgacctcacacttctagcctccagaaccgtgagaaaataaatttctgttgtttaactcacccagtctgcagtaattgttataacaaccctaacaaagtaatataggaagtatatatatatatatatatatatatgtgatagagtagatagatagagacatatacagtcatccctcagtattagcggggtattgcattcaggagccctgcatataaggaagtctgcacatactcaggtcccacagtcaaccttgcagagctcgcatatgaaaagttggccctcaacatatgtgggtttcacgtcccacaaatactatattttcaatctgtatttggctgaaaaaatccaccaataagtggactcacacagtttaaaccagtgttattcaaaggtcaactgttgatatatagatatataaatatctcatatgtatagagcaagcgagagaaaaaatctctaatctctcttccttcctgctctttttggattgcaaactcttctctcataagtacaaaaagtaatgttaacaaagtaaagagaattggaaatagtagtgtttttgaccactagtgttttgtaattttggaaaaaaaaattactgaaatgtaactttttatttatattgagatgttttgactcatactccaatcatacagaaataatagataaaatatgaaaaagacttctttttacatacatagctggattaaaatattagaaataattttcttccctcaaaggatcccctatttaataaacggtgctgggaaaactggctagccatatgtagaaagctgaaactggatccctttcttacaccatacacaaaaattaactcaagatggattaaagacttaaatgaaagacctaacaccataaaaaaccctagaagaaaacctaggcaataccattcaagacataggcacgggcaaagacttcatgaccagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccatctaaccaaggggtaatatccagaatctacaaagaacttcaacaaatttacaagaaaaaagcaaccccatcaaaaagtgggcaaagaatatgaacagacacttctcaaaagaagacatttatgcagccaacagacacataaaaaatgctcatcatctctggtcatcagagaaatgcatatcaaaaccacaatgagataccatcacatgccagttagaatgatgatcattaaaaagtcaggaaacaacagatactggagaggatgtggagaaataggaatgcttttacactgctggtgggagcataaattagttcaaccattgtggaaagcagtgtggcgattcctcaaggatctagaactagaaataccatttgacccagcgatcccattactgggtgtatatccaaaggattatacatcatgctactataaagatgtatacatgcacacgtatgttaattgtggtgctattcacaatagcaaagacttggaaccaactcaaatgtccatcaatgatagactggattaaaaaatgtggcacatatgtgccatggaatactatgaagccataaaaaaggataagttcatgtcctttgcaaggacatggatgaagctggaaaccatcattctcagcaaactatcacaaggacagaaaaccaaacaccgcatgttctcactcacagatgggagttgaacaatgagaatgcatggacacagggtggggaacatcacacactggggcctgtcagggggtggggggctgggggacagatagcatcaggagaaatacctaatgtaaatgacaagttgatgggtacagcaaaccaaaatggcacatgtatacctatgtaacaaacctgcatgtgatgcacacgtaccctagaacttaagattaaaaaaaaacatttcttccctcatgaggtacaaagccaagcattacactggggccatgatagtccaggttgctgaaagatttagatctaaagactgaaaattgggatatatattgagagagagagagagagagaacaaatggtaacctaaatttaataaaataataatagacaaattagggtaacaggcatatgagtactttttgttctaacaattcttttattttcaaacttatctatgatcttacatttatttcccaataaaaaggattttaagttaaaaaaagaaagtttttctttagtaacattttcacaactagggcctttaagactgaggaaatactccaagctctgagcaaactcagtaagtataaatccatatgtagacataccacagtaaaatgcaagatactaaacactaatacaatattttcaaatcaaccagagacggaaggcagattacctgcaaaggaaggacaattactttatcacagacttctcttcatcaacgagaacagacaatacaggaagaacatctcccaagttgtgagggagacgaacagatgacatgaaattctacgaccaaataaagcataattcaatgggcagcagttaacagaattaagctgtttccagacatctatggagagatttaactcaaagatgtcactgtaaatttgattgttgagatgtagtaatggatacttggcaaggttattgaattagttaaacgatcttcaaagcttaggtcatgtatcttcattaaacacatggtgctttgcatttactaaagaagggcctccgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatggtgtcaaccgcatagcagttatttgattggcccattcctttataaaatattttatgcttagatgatgaactctacataaattcagccaggagaatgttttccttggcaatctctgggagattacaaatgttcctttttttttttttttttttgagatggagtctcgctctgtctcccaggctggagcccagtggcgcgatctcggctcactgcaagctccacctcctgggttcacgccattctcttgcctcagcctcccgagtagctgggactacaggtgcccgccaccacgcccggctaatttttttgtattttagtagagacagagtttcaccgtgttagccaggatggtctcgatctcctgacctcatgatccacaagcctcggcctcccaaagtgttgggattacaggcgtgagccaccgtgcccggcctacaaatgttaccattaactcctccttctgctaagaaataaaccaaaataaaattattcacaaatataactgttttgatcatgctttcagatgatatgtaaagtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccactgtgataatttactacataaaagtacaagttacattatataaaaagaatggcctggctcagtggctcacgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttgaacctgggagacggaggttgcagtgaactgagatcgtgccactgcactccagcctgggcaacaagagtggaaactccgtccccccaaaaaaaatgactccaagaaactgaggtttccagatgagggttacacaatgtggatctaaaagcaacagggaaaggaaaaggatttgggcctagaatgtggggaattttagatgctgcagaaagccttctggtgtctttctagaatggctggattttggttaaggcaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcgcaaaatccagcattagcaaagaacactgccaagtttaccaaagaacccctcattctcaatatctgatcaggttcttcattcttcaccattctgcaggtgatgtctgatcaccctggccagtcttcagcaagaattcttttagggcggtttagccagaatctcccttactcctgatgtttcctcttagtgattttccattcactgacccctgcattgctcctgggctataaattcccacttccgcatgctgtattcagagttaagcccatctctctccccagctccaagactgtgttgcagtggttcctatatctatggtgatggtcctgaataaagtcttctttactgtgcatttgaagtatcactgaataattttttctttaacaactatggtgttgaaactcaactaggacagattcatcactggatcctgggcctctcactcagaaccctaaatgcatgcctttgaagtctttgttgtcatttctgactgattagggatccattggtgaatcagattcctgagccattgctccagacaaaagcccgttgatggctaaggacagattttgaatctgaagggatgaatattctctctgaagctggggtagagtcccaggcttcttttgaaagcaatcctctgggcaggaaggtcttcgtgtgggcttcttgttctgagtggtctattctctgagtccctaggctagaagtctcttctttctggctctctttttctgagtgaggggttattccctgattccctgggctacaaattgttcttcctggctctctataaaaccactctgctctttctcttctctctattggatcctgcttctcccatgggagctctgtcacctgaaacccctcttctcaagtctctgctgactatttccatagctggtagtcacgacgaggagacaactgtgtagggtcaatatttgggccaaccaccctgaggaactgtgagggttagaactggaaattgtcaagagaatccgaacccagctaccatataagagagttcaacttatgttcaatgtgaatgccatggcaatattaaaaggtaagaattcaatccatacgtgcttgaggtaaataggagaaacctagaatttatgtaaacagtgagaagattggatgcgttttccgtctcatattttaatactggcagcatattatatatgtcaaaccatcaggcattcagaaatacatgcttatgaaaattttttgcaccatcagacaaaagacaagggtagaagacatttgtaaccctataaacactagtaaattaaaaacagaaggaccttaatgtcctaacatacctgtgttgtgaaaggctgccctgtgaaataccggatttcttaaacatattttaaaaatcataggcgtcaatattttttagatatccttttaaattttctcttgttattttacaatgcctatttatttatttagtggctctgctgattttgatgtatatccaaaactttatattttctttaaaagatgttttatacaactttacgtaaaatgtttctgtatcttcacattctctccctgtccttttgttttgctcttatatggtggtcctgagtcttttctctggcttttcaaacctagtaagactaagacactaaggtaactttgcccgtggtttggtaatgccttctaaagcacatcctaagctctcgtgcatacaggggtctcctttgagctctgtgcttttgagatcccatacacctaaattccagtactccaaatcagtactgctcagttttagtgactaagtttaaaaatgtattttaatagcaagttagtttagtgccctcttgcttctttcttgactgcttgtatacatgtatattcctttaaatgaatcttggaatttatttagaaatattaaattatactaatgaaactgtatattgttgtgaattcataagtgaatttggaaagaatttgtctttatgatgctaaatcctttttatccaagaatcatatgtgtctttatatttattccagtctatatttatatcactgagtaaatacatagaaatgtggatacatacagctgtagttacagatacaaatatagatatagcctgttaaatctatatctatcccatataacatatatacatgttatatgtgtgtgtttatatatatatgtttatgtcattaaagagctcccttaatatttttcttttatttcccataaaatttaggtcgagcttgaattttgcttgtataaacaagtaaatatttatactagttttaatactgatgtttagacattgtatcttattttagtgctgaatattttcacaattattataaatatcatctaataataataatgtacctgataaaaatatttaaaattttacctttgaattattttattgttgaattaaaattcctttaatatgatagtcaatttctgttttatgctttctctatgcatatgcaaattaatgtatccacttctctgtctctatgtagtaacatatgaaaatcaggcctctcttcttctaatggacatacacatgtttgcatatagaatatcagactctttatagcatttaaaacctttaaaaacatgaatattgccttttaacaaacatattttagcatgtactgagaatcccctatttatttttaatttgggctaatcaatacgattattaatattactggattaccaaatttggaaacacactttcatcccgaaggtggatatttgtttttttttttttttttgccaatttcttgtcttactgtttcaaatattgttggatattatttgtattttatttggcattttagtatcaacatttgtaattgaggtactctacatattttttcatcaatatctggtgggtttcatagttactgctatattggatttgtagtagacattgacaaaaattattcctgtatgttttatagctgtatgaaggaaactaatatattttacccctaaatatatttccttgatatatttcaaaatggctattgagaagggctggaaaagcaatgttagctgcaaagctgtcttggggagatttgcatcggtagagaatctgccctgatgcagccaggttttctctgaggtctgcccccttgtctggatctaggaaaggttaactgagaggctaagtctccaaaggtctgaaagaaacattttctgtctattctctctgaggactactcccagtgaggttccacctatataataagtccactgttgctagccagggtcgttttctcacataacctttttctttcttttccctgtgatccaagaccccatttttctgtaaacttcatgtggtagataagcttctgcacgcatcgtgtgactgggtcttcgttctaagggttccagtgtacacacattacagaaacctgcatgccttttctactctttatctgcctcctattagtgattttcagggagacttcagaagacaaaagggacattctcctttagcctattctcagaccaattcccccaacatttaactgattcctaatagcttaaaatcactttgaaaaatccatatatttataaccttttcttccctctatgatttctggtcagcttgggttttgtttttcattccatttacttcatcctcgaaaagatctattttacgtctatttattctcatttatggacattgagaaaagaaaataactttcatgtgagaaatgcaagtcctttgaaataatcaggcccagagagatattcaaatgacacagcagttctgtcctgctcctctttgagctgtgtgttcatctaggctgcttgctgttgccacagtagctataaattaaccaataaggccacaccagacactataatccacaccccataatagtgtaacagtgtgtagccagtcactaataaatgttatttccataagccaatgagaatttgtgacaaacctctttgcgtcatcacacttctggacccttttttgcctttaagtaactgcttgttgcaaagctccaaagggagttcacatccaaggatatttgggtctgtttcttccaggcagctgtcctcactgtggctcaagtaaactctttgaattacattttgtgcttcagctccttccacttagattaacaacatggatttgtgtcaccatgtacagcaattaaaatgtttacacttttcccctcgagagcactgatgtgttttcctgagcacttggaatagctacgtagtgtttcctgtctagattatggtttctcaaccttggtgctacttacctttaggaccagaggattctttgttgtgggaggctgccctagcaatgataggtgtttcgtttgacctctaaatttcacacctccaccagtcttgacatccccacgataaccctagacattgacaaatgtctcctggggaaaactctccaccagttgacaggtaaagttctggaaatattggatttgtcaattgagattttatgttatccaaaacaaatatttttctttgttcttaaacatctacttccatctacttatctacttatttttacttttatttgtaacttaattccatcaaggagagagagtgcattttctgttatgctaaatttttgaagaatgtattgatattttatgacctgatatatggatgatatgtagatattacatgtttgtattatcaaatttcagggtgataataaaataaatacttataatatttatattgtcactgtatattagttattttctttcttcactacaggagtttttcaacctataggctatgtttcaattctaggttatccagtagattttgaaatgttatgattaaatatctacttctcaagcattcatctttgcaaatgaaacaatcctaagctcttataatacacatcatataaagggcagattagtcaatgtatggttcagaaataattaagtaatatttataagaaaattaaaaatttatatccttaactcagataacaataatccaaattaaaatttgatttcattacataatttaaaatgacatcagaatgctagtaaaaattatacaaaaaatttatgtaatcttattaagctgtgggactttattagcataaattcaaatacaggaaccaaagtaagattgagacctatagtcaaaggttaaaatgtacacattataggggcatgattaaactaatttaaagcataataacatggagaaatattgcaaaacatacattttactgaattaattgttagtatctaatcattttgtgagaaccaaattaaaaagtagctacacacgcacacacccacacacaagtgcaatactgtcaaataaacgatgttcagctacactagaaatcacacctgtgttttctccacagaaaagattaaaaatcacaataatttttattgtacatatggaggtaaagatactcaaaatattaccctaaaatacattatttttttgagatggagttttgtttttattgcccaggctagagtgcaatggcacaatcttggctcactgcaacttcagcctcccagggtcaggtaattctcctagctcggcctcccaagtagctgagattacaggcatgcaccaccacactcggctaattttttgtatttagtagagacggcgtttcaccatgttggtcaggctggtctccaactcctgacttcaggtgatctacccacttcagcctcccaaagtgctgggattacaggcatgcgcctggccagctttttgacatatttcacgatggctactcggaagactggagatagcttcttctacaagaatagctgaaaagctgtgtttgttggggagatttgcatttgtagagaaaatctgcattgatatagacaggctttccctgagatactcccttgtctgggtataggaatgattaactgagcctggcacgtttacatttctaaaagccatttcctatctatacttcccaagaggagggctgctccctgtgaggtttcatccatgtaacaagaccacctctgctgccaggctcctctttcttccttgtcgtcacctgtcttccacaaagcctgatttaccaacctacagctctgtgttttctgcaacctcaagacagcataggcgtgttgactaccttgcctttcctggagtttttatataaagagtatatatttgtatatctctttataatatacaaatatttgtatagatataatatatatattatgtaaactccaagtgcatacttgtgcacatatctgtaaacctttttttcctgttaatttgtacattatcagtttgttttatagactcaaataattaaagcttcaagggaaaaatttaaattttcctatagagaaaagacaaatatataggtgacaaataatatttagagtgtaagacgctttttaaaggtatatttgcaatttgtgtcaaaacattgaaatgtacatttgttattttaacaataaaatttcaattaatttaagccaaatacatagtatatgcagaaaatttagcaatatatctatgtagcaccttactgtgcattattgtaaccagccgtctaatataaagaattaaggtagcagctgctttccaaatagcgcatttttttcacagacctattaaataagacaaataacatttaaactttatttttaaatttgcagaatagcagttttcagcagatggtttattttagcaaattccatcttcacattgtgctatgcttttatgagttccagctgttaacggatactattttactgctgaaactatcctgtgtgatataattgctcattatgtgccttaaaacacaagcaatataattattttcaacttggagcaaattaaaatcttatcagcaatttaaaatctctagagtcatcttcttctggttaattattttaaacttgtatttttctctttatgtttttagtgagttctcttatcaaggagaagatctcaaggtgattattcttttttttctcttccatgcacctcgcaggtgtgttaataatttcatttctcagaaaatattctttcatatctatcttacaagatgagagaccttttaatatcttccattcggatgtgataccagtaatggaacatattccagcttcatgaatatggtgatacaaatagttattcatctaacctctttcagtgccaaatgtttactatactcagtgagttactcagttgactggtaatttcttctgaaatcactaatgagaggatcagaggtctggctgttgtctgtacctcatatgactcccagtgcagacaattgtttctatggagcacagacagttgaaaggattgacttcctgcctagaatagtttctgctgtgcttcttatccttcttgtggagatttcagattacctgaattgcttttctatcttaagaaaaaacgcaacaattctcccacctgagaggaatgtaaactgaagtaagttaacagaaccaatccataaagtttttacattgtttgttgcaaaatgcagcgctggtgtctccatcactaaccttttctatccctcattgctctttctttgactgcaataggatacctctatgcaaatctgtattcccgagactgagtgcccttttggtgagctataagcacactcaatggtaggctgaaatactagtttttatctatggcgaaatggaatcatatcagtgaattttttaaaaaggaaatttaactcttgctgtggtttgaatgcttgccccttccaatctcatgttaaaatttgatccccaatgttgcaggtggggctcactgggaggtgtttggtcatggggttggaccttcatgaatggataaaactctcccttagaaatctaaagctatcctccctcctcggtgccctcaggaatgagtgtaccattccttattcacctatgattaccccacccatcctttttgagatattgactacatgtatgttacactgatgcacattgtctgacctatgagtgagtttctggttttcttattttagtttaccgtttgtcctttagtttgtaatgcttctaatttgttctataaatgttctgatgttagggtaaaatccattacttattctatctcatggaatttttatttcaagtatttatttttcatctatatatgtcacatttttcattttataacttttatttttctcctatatttaattttcatttaagtaccttgacatatatatgtatttatctatatgtatttataaaatatatttactttaaggatcttgaaatttccttcttttctgtcatttataaatgacttatttttatcctgttaatatatattttaattatatatgtcttacagcttctttgcatttcagagttttttttgggtattttgatgttatgctattgaatatctagattttattggctacctttgaataatgttgtgacaggcagttcagtaacttcaggatgagtatttgtctgttgttttaaatcttctctttaaactttgttgagttagtctagagccatctgtaatttggagctaaatgagcactgtcactagggcatgaacctccagtggtctttactgaatatcctggaggtacagaggggattcccttctctgattagaatttggaatataaagagaaaagagaaaaatagaaagctatgcataaacacgtgcattaaaatgaattttatgtgggctttttcatgaaaatgttcctaaggtattttattttttttattgtggtaaaatacacataacataaaatgtactctgttaaccattttaagtgtacagttcagtggtactaaatatagtcataacattgtgcagccgtccctaccatccatctccataattcgtttcatcttgtaaaactgaaactctatacccattaaacaatacttccccatttcctccttcccccagcttctggcaaccatcatcgtaccatctctataatgctaatcaagcatagtggctgtgtttcttgcttcctctagtccgcaggtagcatacaaatgtaataaactacttattcatgtcgcatctatttattttctgccttataccaagcttgtgggattctcttaaatacaacatttttatacttacacctatgcaatacccattagcatcgccttcctaaatcaggggaaattgagcttctgtcaggtggagtaacttcctaagatataaaactcagcattgaagtctgtatacttcaatatcctgccctcttctcatgtgtctttactgccttttatgtatgtgttagatgttcaacaaattctcttttttaaactgaatttaagccgtggagcagtgttttgttgaacaataaatatgatataggacactcttcctccttttcatgtatgatcctgttcatgaaaaagagaaattctttcattgtgctagaagcttaaaataatgaaaatgccactttctacattaaacagaaactgaagggaatcaaggtgaattgcatgagacatagaaaacaagtgggaaagaaatctagtataatttgccctttgtgtacctttattatttagcgtttgagtaaatgattcccccaaatatcttcccatctcaattcatgtctataaagtagacgtttatgtctcaccttgtcaagaagggcaaagtctaacataaacatttcccaaaaatgcttcctgctaaaacgtaagctcagtctggctagaaatgcagctcacttcctaaagattaattggtagctaattttgcatgctgttctctgaacttgagtgtaacctgtccgtcaggcatacagggaatgacgggaaaggtgacaacagaagatgaatgctatgtcactaaccttcaaagatgacctgccttttctttcaaattcttgatatcttaagacttcattaattcatctctcttttcccttggttcaacattttgctataccaaaactcatgtgagacaatgacctaatgtaataaaaatggcatttttctttcatgtagttgcaagctaactggcatttttacaatccacgtatttcctttgtcagtttttcattctgtattggaagtaattgatgggtatttctgaagggatgaaggtgtttctgtgttcattgtgatccaaactatttctagacctaggggcctttgtaaacaatttgtgcccactgaccaaagatcactgtggcagaaagcagcaaacttgcataagatgtcactgcttcataggttggctttgaaaactaggggcttactctatactcttatgaataaaagacattgatagatgtagtataagattacaatcatattttccttttgacagtcacattataaatcaagatgtattgcaattaatctcaattagctgatcacaattaaaattaataatgtttattattgctgataaaaatcatgtctctcctgttctcaaatgtgcaagtaattcttgtaattttaatacaaatttgcatattattattaattgatttaatctcattggatttggttcatggatccaatttattaaaatattgataatgggataatgagttgtctccccatttcatgtacattaaaaacaacatttcttacaatggtctgcaagcccatcatcatctgccgcatgttaaccgccaaaattattttatatcttcacccttgatcttaccagtggtcctggccacctcactgtcctctggacataccaacatgctgctgccttacgatcaagactctagttaattttttggcttggaaagatagcccaccatatatccattgatcagctcattcaacttcctcaggtctttactgaaacttcacattctcgatgaggcctattcagtatttcaaactgcatcccagttgcaacattccaaaaccccttactcttctgtgtatttttgaaaggatttattgagatataatttacatagtgtagagtgcacacattaatgtctacaagtcagtggcttttagtatatgcacagataagtggagccaccatcacaatgaattttagagcattttcatcacttcaaaaagaaaccccaccttccctagctgttaacctcctatgcacccatcccctactcaatcctaagcaaccacaaatctgttttctgtctctatagattttcctattctgttttcatctaaatagaatcgtacaataggtggccttttctgcccggcttcgttcagttggcataatgctatcaaggttcatgtacgtattggtactttatttctttttataactgtataacattcaatttcatggatataaccttttgtttatccaataatatttttattgacatttgagttgtgttcagcctttggctattttaggtactgttgctaaaaatacttgtgtacaatttgtgtttgaacacctctttccaataatctgggtgtatacctaggaataaatttctgggtcatatgacaattctatgtttcatatatttagaagccatcaaattattttccaaagtggtcagttctagccatagagtatctaactgtggttttgatttgtagttgcctgaagagtgatgctgttgagtatatttttatgggattattgaccgttcatgtatcttcttgggaaacacatctattcctatcatttatcagttttgagttgggatatttgtgacggagttaaaccaatttttctatattcaagatacatatatatatacagacatatagatacgtgtttttcaaatatcttctcacaattttggagctgccttttgacttgcttggttgtcctctgaaacaccgatgtctttaatttttaagaaattttaaatatctaatttttattctgttgctcatgtttttggggttacagctatttctttgctagatccaaaatcctgaagattttcccatatgctttattctacctcttgcatgtgtgtctttaattcatttgagttaatatttttgtatgctttggggtaagggttctaatttattattttgcaagtggtgatccacgtgtacgttgttgacccagtgtgttcaaagactgtctcttcctcattgaattgcacatggcaccactttaagaatccattgactgtagacacatagttttatatatggactctcaattctcttccatcaatctatatatttttccttcatcaatgttgtgttgtcttgattactgatactttgcagtaaggtttggagcatggggtgtgaattatcctaatatgttttctttcttcaagattattttggctattttgagtcccttacaatttcatgtgtattttagaatcagcttgtcagtttctagacacaagtctgttgggatacttgcagggatttcatcaaatctgtagttcaaattgtaaagtactacaatatcaaatcgtccaattcatgggtgtaaggtgtttactaattatttaaatattctttaaacaataatttttaattttgagagtaaaatcttgtatcacattttccaaattaattaatatttcttttttttatgctattttaaattgaagtgttttcttaaattcattttggggttttcattgcagatgtgtgcaattgatttttgtacatttaccttgtctgctgtaatattgctgaaataatttacgagttctatcgttcggtggattccttaaaattttctatatacaacaatgttattttcaaataaagttttatttcttcctgttcaatatggatgactcttattattttagttgccgatttgccctgcataaaatctttagtacagtgttgactagaagaggtcaaagtatatatcctattcttatctctgaccatagcgggaaagcatcctttaccattaagttgcctgcttgctgttggcttttcacaggtgccatgtatctggtgtagaaagttctctattcctggttcattgagtttttatttttatttttaatcattaaagcatttggattctgttaaatgtgttttccgaatctatcgagatgatcatgaattctcttttcttattctatggataagatgtatcaccttaatggattttgggctgttaaaccaacctgggattacttgtataaatttcactttgtcatagtgtataattcttttatatgttgctagatctgatttgttagtattttttaaggaattttgcatttatacttatagtagttttatttttctatgctatttggactaatttttgtatcaaagtaacactggccccacagaataaattggaaagtgaatatttctcttttttaaaaaagctagtcaagaattaatatcaattattcaacactaacaaatattattattataaaatattaatttctctaattttaattttcttccttctgcttgctttaggtttagtttgctattcgttccagtgccttaatgtggaacgtcatcttatctcatcctttcctttgtcttttcattttgtaaatagtgtcttgttagcatcaggtgagctccccaggttggtagtactccatgtttgttgctgtacaacaatgacaggtaatatgtcctgaagacaatggaaacttaaccttcaaaatctcctagattccaccttatatgatatgtctcttctattggtcctaatttctaccctttctctattataaaccatgagtacaatggcattcaatgagttctgtgagtctttctagtaaattcttgaaactgagggtgttcaggggaaacccctgaactggcagttggtgtcagaagtgagaatcttcttacatggcctcttcctttgaactgtgcagctggacgcaaactctgcacaatttgggccagaactctcgtgttgactttgtagcctaaagtatcttgtagtttgtctaaccctcaataaatttgctttcatcaaatattgtatttgttaccccaaaattaccatcacgtttttttttctccaaataactaacataggagaaatagccagctgagtttgtaactcaacagaaataagtgatccatataccatataccatataagtggccatttcattttgccttcttccaccaaatcttagcaacctcaaccattaccaagagccactgtaggcctaccagctacaaacaaacgagtatcttgtaaaaacacttcatactcccatttgataattttcccagcaaagagatgcctactttaactctatgcaagtggctcatattcacgaagtctgtagatattattcatgtagagtgagaaaatcatcccagcggtgccagcacattctccttcccatgatctgcttagtttgcaaacatattcaggccatgggtgagagatttgtatttcacagtacaacaattttatggagggcattgaaacttacattgagcattttagtacagtcacacatcactgaatgatagggatacgttttaacagatgtattcgtaggcaattttaccattttgcaaacatcacagagagtattacaaacacctagattgtacagcctaccacgtttaggttatatggtatagcctctttctcccaggctacaaatctgtgcactacattactgtactgaatactgcaggcaataagaacacagtggtaagaggttatgtatctaaacataattaaacgtagaaaagtatgtaaaaatatctattataatctcatgggaccacttttgtatatgtaatccatctttgactaaaatgttattatgcatgacatgactctatgacaaaaataaaataacacattgtaaaaaaatatacacaggtatcaaacatattaatattgtaaaaataaaaatatttattcagtgtaagaattcgtaatgatcacaaaatgttcacagcttatattttagtacagtttcaaatgcctagtgcaattgctatttatttctgtattttaaacatgtatataataaatatttttcaggttcaacaatatatatcaatccaactggctcttataaatattagttaacatcaattggtaaattcatatatatatatacacacacgtgactcagtctgtatgcgtgtatgtgtgtgtaaatgtaactgtatgtgtgtgtaaatgtaactggatgcatcctaatatttacccttacctacaagatttccaagactcatttattctctttaaatggtgtgccttgaaagatttaccaaataaaaccgcaatcgtggaatatatcaagatgttattaaattcatcttgtgcacataattgtttctttaaatttatgtttcttgcaaaacttgcggtaatgctcatgcacaaaataattttctaaataaaaaataaaaacattttctcagtcattaattcttaaaaagtatttctccccagtaattaatgtgaattaattcttaattcttaattatagaataatgttgcccttcagagttctgaatcttttgcacgttgtatacagtttactgactggaacatcttctggaatattggcattaattaatctcactcagcaattaatgatttcaaagaaattaaataccattcatattctgaatcacaagggtactttggcatctaatttaatcaagctctttgtatcatcatctacactttaattacttaacaaacatttctctgtgtgagaaagattgagcaggttattgtgcttttttatgatgcaacttttgcttaatctagagataggcaatgctccctataagggacaaagagaaaaatgaaagagcaatagagatgtgacaggcatggaaaaagacaatacatttataaaacaaatagggccacagatgatgataatggggatcaaatcttgagatactgactcagtttataaacgcactgtacaatagagcaaatcatttgttaattattttacaaatggaatctaatttaactaagatgaatacagtgttttaaacaaggcaggtcatcttaaaataaaatagtgggaaaagtgataaaaccaatgtaaaaatcataaacattttataaagaatttttgtcatgtaatttaatatttttctttatttaaaatcacccaaatcaaaataattttatcttaattaacaaataatcatcggaagttaactaatttttactttataatactaggtttaaaaattcttcactatatttttaatcatacatgcttatacataaaatagacatagggtatatgtttacatgttcacaatattatattgtaattgttcttatggatgtggtttttcaatagaattaataagtacttttaaaaagtttcaatttcaatgatatatatgtttgatttttctttgacaaagcatacatatattgataggtaataataagaaaatcttctaaagacattacaggaacatgaataagtaattaaatcctcaataatttgtaacgttttatgtaagcggaacacatttaactgaaaattgcttttatataatactcaaacgagactaaaaacatattaactagcggagtaagtcttcaaattgataatctgaactataaaagaggagaaacttcaagcactcaaatatttgaaatgctacaaaatatttatataaactattatttaacaatttctgtttgtagagtgctatagagtaatcgatgtaaatgacatctcagtctttctatagctttgaccacatttacctcctaattttaattattaatatgttggagcagtgcatacaactagattccgatcttcctttttaatgagtaaaaatatgtcctttgagacagcattaaagaaagagcaccttgtataaattcaatgccaagagacaagatattcttgatgctgaagtcttgttcttttatacagcaatgtaattaataagaagaagaaaagcaggacatagagatggagtctattttcatcaaaaattgtctatagattttgatgataaaatttaaaactctactatatttagttagtcacaaaaaacgaggttgtgggaacatatttggtcaataaaacacccctaccaaaagccgacaagaaaaaaagttaagtaccacctttcttctctgcagatggcctgagatgggttaatttgaaagaatgcttccaaacctgaggtgacccctgagaacagcataatccactgctgtctcccacattcagtttctcagtctgtgctcttttaattttggggggagggaagccagtcctttaaagcgatcttcagcatgatggcagagccaaggagtgtggacaggtggcacggtgtctgattttgttccagcagccacttgggctttctctgggtcttctctgccctcgggatagcactactattgaaaacatgtctttgtgacattctctatgccaggaactcccaacatattttccttgaaactgatgaaatgaaaaaaaataaaccaagaggtgtgctgtttgtttctgtttcctcctttctgcagcccttcttgatcatctaatatttttaaatacattgtcgatcaccaaaaggagcataagggctttattggtttgtagcagatgtattcatagcccagcccctattccttagctgtagctgctgggaagaaaaccattcttaacactctacaaggtctcatctccagaatttgcaccagtttctagctgaggactttctctagcagcacgggagcttgttactgggcatgaagtgggaagaaaaggtgagggtaactaagaagaatctccctggattcagtgatgtaattctgaggcatgctccacatagcttcccataaaattaagcccagatatctaacacagggacttacttcttaacacgtgtggtattggcttttctgtctttcctgttttattttgttctcttttccttgtctcactttcgctgtgtcctcactcctgctttaagaatacccaaacaaatacgttcatttatttttttagactctcagaacacagttgatagttgaacttgtaatctatgataatcagcttggatgctgtattgacaggaagatggtgaactcacaatgtctaattaagatacaatttaaaaaatatattgaatcatgtccaaagacttaaaaagcctaagcggcagcgtcacagtttcttctttttagtttgcatggtttcttaaatgcctacaattattttaaaggaagccttgagtctaggaaaaattgagacatatggaataaattactaacccatttctccttgaaatccattagatgtttgatgattcttcacatatatttctgaactgaaaagctagttgggaattatttttataagcatatccttatgtaatatattggttctaagagtgaatggaaggtttaaagattaaattattctatccagagaataaaaaacaattatttcacaaggagaacatgtgtatgttgacacgacattttaaaatctagattttaaaataggtcccatataattttgagtcaattagaatacgtttgtatcagtctgtctacagttttacacctgtcaaatgttacttgaactaaaagaagtaccttgaacaattttgaaatttattattcctctgaaactgatgaaaagaatgacggtagagtgaaatttggattggcataatttaggagagaaattattccttggagatcaacctctgccaagatagtttacaatgacattgatactttttgatttacacaatttgttatataaaaaatactaagacgatgacagataatacacagactttaattaaaattgtactaaaattaaaagtctaaataaattacaagtgtacgtggtacacctaaacgtatgtttatatattttatttgtgcattttattcctagggttccttttgctttagtttgtaaaacgttcttatttttatggcagtgtagtatatactaaataaagaaaaatcaggaaatagaaaatgaagaagaaaacattagctattgtcaaccaaataaaaattgtgcaatctctaagtacatgaacgatgtattatttgtacagcatgtacaatgtttatgcttcacagggtgaggtagagactgcaaaacattgaacctgggacaaataagaaagaaaggaaattttcacaatatattaatattacagaaaatgttgaacttaacagttaagatacaagtagtgaaaaatgatagtatttaaggagatctagaaaatgtcatccataccagtaatgtgtgagaagtattagaataatgcttgtatttctggattggcatcgatttctattgagactggaaacatactagaagtgagcaaaaaagaatttaaatagtggatacttgagttttatacctaggaattcgagaaatacattttgttactgtcaaagcagttggcacaagagtgtacaaaattccctaattgtgtctatgtggtgaagacatagacaaacagaaaatagcaaaacagaaatagcaaaaaagcacaaataaattttacctgtattttttacgtaaaagccaattagagtaggaaaacatgaaatttgtgttttatcgaaatttttctcttatagtatagttgattatattactggaaaaaaattgaagcattggtatgttcacaaaaaaaagtaaaagataaggtcaaaaccatgggaatgcagggagcagacaaaatacacctaaacactgatactgattttgccctacggacatgtagcaaaatgaatgagtgcagattcctatggtcatacatcacataggacagtaaagaaatacatagtgtttcccaagatagggcatcacacaggagctcttccctaaagctagcaccaaaatttatctcctcagtataaagaagaatcagaggtaaattagtctcatttcacattccctggaaatggcaaataaaaatgacttgagattggacagatttaaagaaactcaatcattaatgatttacagcaattaatttaaaaattgtttaaatgtgctgtccaaacatacgtccaaacacctttaggccaagaattaatataatgtggtcccagaatggtggtgcctttagtagactcacaaaaaattcaaattctctttggcaaattttcttcttactaatatgcaaaagtgcacaataataattttcagagaaaaataaatctttgtcattcaaaggcatctaagtacgcaaggaaatgatattccaccatttgaaaggaaagcagaaaaagagtacaaacagatccacagaggttcattagtagaaatatcactgttagattataaagcacatttgctttcaaaaaatttaaaaaaaggaatatatttttaggagactaaaaagttgatgtagtaaatttgaaaagtagtttgtatatagtattttaaattaaaaactcaaaaatgaactcatcagattagacatggccatggtgagagctcataaatatttcagaatgcattacagaaaatttaaaaaaaggcacaatgtggacagaatcatgaagagacatggaagatacagtgagaaagtgtagcatgtgtttagtgagtgttctcatagaggaagggaacggggaagggacaatatgtgatggtattttggctgaaagttctctagagttttgtaagacactaatccacatattcaaaacttctatgcatgctaagcaagctacgatggagataaacctacatctacatatctcctagagaaatagtaaacaatcaggaagggaaaaatatttcaattagcactagaaaaatcaaattacctttaatcatattgaaatctgaaagcatgaaaggtaaaataaacaatattatttgttaagaataataatgccattctgaaattctcaaccaagaaaaatattcatcaacctatggctaaatcacatatttagagacaaaaaacaaaacaccaccagcagaattccactaaagaaactcaaaggaaactctgaaaacacgcttcagaaagattgaagttctgaaatcaaagaatgaacacagagcaaaatatattgtaaacataaagatagatcaaaatagaaaattaggtgttgaaacaaaagaatatttaaaattaggtaagcactgcaatatgtatgttaggaagcaaattattagggctgaagtattcaaagaccccttaattgtctgacaagagcagaaaggtatgactttgcaattcttttttttttttttttttttttttttttttgagaaggagtctcattcaccctttctcccaggctggagtatggtggcgtcatctccgctcactgcaacctctgcctcccaggttcaagcaattctcctgcctcagcctcctgagtagcggggattacagccgcgtgccaccctgcctggctaatttttgtatttttagtagagacggggtttcaccatgttgatcaggctagtctccaactcctgacctcgtgatccacacgcctcggcctcccgaagtgttgagattacaggcgtgagccactgcgcgcgaccgactttggaactttaataaattgactggacattatgcatttctctgttgtatctatgaaaacaataaaaataaaagtcataattttaaaacaagaagacagaaagtgataggagaaaatgagacattatatatatatatatatatatatatatatatatatatatatatacacacacaacaaattactaatacaaaattaagtataaatgatcaaagattaacttaaacctaagtagacaatgtttttgttaaaatacaaagattggcaaaatttaaaacatccatctctatcatagttacaagagacacagctaatatataaatttacagaaactttgaagttcaaacaatacagatactgtgtatatatgatatacatacaaacacactacatgaatataattttttaaaaagttgctatgtagaccaaatagaagttagaaacatttattaaaataagttagtgtaaccagtgtgataaaagttttaagttattaagaagatgtgatgacttcaatgtgtattagcctgatacatacatatatatatacacacaaaccacacactctctctcacacacacagacacacacgtatttagagagagagtcaaattatataaagcaaaaatatcagaaagtaagtagaaatggataagcccccaaatattatagacatttcaaacacacgtctttcagtaatagataaaagaaaaaattaaaagagtaagttttaaaagaagctagtggattttaaaacgggcaaatattatataaggaacttgaatattataattcatgttattttcatgttcatacagaatacttacaaaaattaacattttctagaccataccacaaattcaaacaattttcacggaaataacgtgacacagaatatatgtcctaaacaaacagcaatgaaggcagatatcaatacaaaaacgaaagttagaaacataagtgtaataatattggttggaagccattttattgaatattgaaatattttaaaggtgaatagtcactacaaataaaccaaacacttttgtgaggccactaagatgcatgtgtaatgtgtaatgcctccttttataaggagtaaatctgtaacatcacctgggctatttgacaactgcaaagtgaatgtgagaaggagagaaacagtgagagagagagagataaaagcagtaaaataaacataaagaatgaaggagatagccaggcgccattgttcacgcctgtaatcccagcactttgggaggccgaggcaggtgggtcacctgaggtcaggagttcgagaccagcctggtctaacatggtgaaacccactctctactaaatatacaaaaattagcctggcatggtggcatgcatctgtaaccccagctactcgggaggctgaggtgggagaattgcttgaacgtggggtgtggaagttgcagtgagtagagatcacgcgactgcactccagcttgggcgacagagcaagactccgtgtcataaaaaaaaaaaacaaaaaacaagaaagaaaaaaacgaggaaatagtacacgaaaaagcagaattaaagcaactgggtatatatttaaaaatgcaaaagctcactttttcagaaaaatattaaaatattaaatctaacaaatatctaggtagactgatggagaaaaatacagaaaatgcacaaaaaagcaattacctggaatgcgaacgttacaaaacgtcagcagttgtagattttaaataagcaatgatttttgagttcaaccatgatggggtatattgaaaagaatctctcagaaaaaaagaaaaagaaaactgttataaagctatgtacaaaatgttaagcactattaaagtcttccaaatctaccagttacggagttattggtcttggactaacactcctgaaaagaaaaaaaacaaacaaaataagacaatacctaaaaacctggataaaatggcctaccgtgggcactggcaatgcatccaagcaggtaggacctgggtgctacattctctttgtcagaacacaaagcattcatacactcttctcaccctcactttcaccttttaatctttgatctactattaaatgtattcaacattactatcaatcctttgctcaaaatttctttactcacattttgcttgatgcacttggatagactgttcaagaaagtgtgagtagtgaattcctcaaactcttgcatattcaaaatcacatttttgaacctcgatgcttgaagtgtagcttgggtaacagatgggctttaagccaattttggcatgcaaggggttgagtttattaggcatcagcaccgctgaaaatcgtggggatgcaggcttaatttcaacactattctaaatacttgaaagatattatataagtctttaataaactcctgtgtctacaaatggttcacattaactcaatatccatgatgaaacatctataaaatcaaggcactgttatttagtggagacttgctggctattctatgagaggaggtattgttattgtaatctcatcatctcataaaattgtatcatattactcataaccagcccttcatattctattcctattttggtattttaaaataagatatctttgaaattcttgaattcaaagagggaatctgaatactttttaaaatgtcaatgaaatgccatttcttcatgcttcaacaactaaaaattgactaaagtgcttctcttcaatctttctgggacattttttatctaaattctaagaacaatcacaataggttttaaccacaaatgtgagaatattctaaatgttagggtggaaaaaatttttaaatattttatagtaatttttttcatcatagtgacagtgtgctaaatttttttaagccaactattactgtagacatttaagtcaggattctaagaagctgttctaaagtccaaaattcagtttcatatacactgatattatatatatatttgcttaaaaaattaatacatgtgagccgtgtttcaaatagttgagagattattatatcaaagattcttgattatataaaatgccaattacttataggcagacatgctttaaataattactaaggcagttgtggttgattctactcttgctactggcatttatatggacatactattatggtctgaagaatatttaggcaaatttatccctcatatgatcagaagaacaatgcaagatagtttatatctgaaaggaaaaaaatctttatatggttctgaaagcgtaaatcattaacaacttggataataattagcataaaaatacacaaacatgccctcttcctagcagtaagtacacagtgacaacagaatcaaagcatgtggctatgtgcatgtttatatttcaagacgcagagcactctattcctcctctctgccctttctagatggcacaatccctcatgaatctaagtgcagtcatagggtggattagggtgacctgccatttgtatgcaactgatctctagtttggaagtaattaatgtcaaaatatatttttaaaaggtaatttcaaatttcagggcaaactagcatggtttcgccccttttctttggaacattttttctaaggttggaaaagtaaggtaggctttagtacgattttaaataataagttttcaaagtgagacgcaaaatggtggcgccaacacatttcaaatctgctacattttgaagacacttattggagaaaagaccttctcatcatttttctcttacaggaaaggaaataacacgtacggttgacccttaagcaacacggaggttggggtgctggaccccctgcacggtagaaaatacactataactttgactcccccaaaacttaactactaatagcctactgtaagcctgacaaataacacagtcaattaacacatatttaatatgttatatgtcttatatactgtattcttaacaaacatgccagagaaaagaaaaaagaaaatcataaggaaaatagatttactagttattaaatggaagtagatgatcaaacaggtcttcatcctcatctttctcatgggcaggatgtggataaggatgtagaattgttggttttgctaagtggacgtgcacagttcaaacccctgtggtgcaaaggccaactgtatagccattgaatagcaatttatatttagaaattaacctcactaaaatactcttagaaagatgcccagaaaaaaagtgaataagaatttttggttcatctattacatcatttcatttcattatttcatttcttttcatcatttcatttcatttcctcatttcatcctttcatttcatcatttcatcatttcatctcatttcctcatttcatcctttcatttcatcatttcatcatttcatctcatttcctcatttcatcatttcatttcatccttccatttcatcatttcatcttatcatttcatctcattttatcatttcatttcattctttcatttcatttcatcatttcatctcaacatttcatttcatcatttcacttcatctcatcatttcatctcatcatttcatttcatctcaccatttcatttcatctcatcatttcatttcatctcatcatttcatcttttcatctcatcatttcatcatttcatttcatcttttcatctcatttcatttcatcaattcatcatttcatctcatcatttcatctcatttcatttcacttcatttctttgtttcatttcatcatttcatttcatcacttcatctcgacatttcatttcgtcatttcactttatctcatttcatcttttcatctcatgatttcatttcatctcatttcatttcatctcatttcatttcatctcatcatttcatttcatcttttcatctcatcatttcatcatttcatctcatttcatcatttcatttcatttatttcatcattgcatcatttgacttcatgtcatcatttcatatcatttcatcatttcatgttttcattcaatcatttcatcatttcacttattcatttcatttcatcttttcatttcctcatcatttcatttcatcctttcatcatttcatctcatcatttcatcctttcatttcattatttcatttcataatttcttctcattgttgcattttgtcattccatcatttcatcatttcacttcatctcatcatttcatcatctcacgatttcatctcatttcatctcgtttcatcttttcatctcgtcatttcatttcatctcatcttttcatctcatttcatttgatcatttcatcaattcatcatttcatcatttcatttcattatttcatcatttaatcatttaacttcatttcatcacttcatttcatttcatcatttcatatcatttcttcatttcaccatttgatcttctcatttcatttcatcatttcatcatttcacttcatttcatttcatcatttcatttcctcatttcatttcaccatttcatttcctcatttcatttcatcattccatttcatcatttcattacatttcatcatttcatcatttcacttcatatcatttcatcatttcatctcatgatttcatttcatctcatttcatcatttcacttcattctttcatttcatttcatcatttcatctcaacatttcatttcatttcatcatttcacttcatctcatcatttcatcatctcatgatttcatctcatcatttcatctcatttcatcttttcatctcgtcattacatttcatcatttcatttcatcttttcatctcgtcatttcatttgatcatttcatcaattcatcatttcatcatttcatttcatttcattatttcatcatttaatcatttaacttcatttcctcatttcatttcatttcatcatttcatatcatttcttcatttcaccatttgatcttttcatttcatttcatcattccatttcatttcctcatttcatttcacaatttcatttcatcatttcatttcatcattccatttcatcacatttcatcatttcatcatttcacttcatctcatcatttcatcatctcacgatttcatttcatctcatttcatcttttcatctcgtcatttcatttcatcatttcatttcatctcatcttttcatctcatttcatttgatcatttcatcaattcatcatttcatcatttcatttcattatttcatcatttaatcattcaacttcatttcatcacttcatttcatcatttcatatcatttcttcatttcaccatttgatcttctcatttcatttcatcatttcatcatttcacttcatttcatcatttcatttcatttcctcatttcatttcaccatttcatttcatcatttcatttcatcattccatttcatcatttcattacatttcatcatttcatcatttcacttcatctcatcatttcatcatttcatctcatgatttcatttcatctcatttcatcatttcatttcattctttcatttcatttcatcatttcatctcaacatttcatttcatttcatcatttcatttcatctcatcatttcatcatttcacttcatctcatcatttcatcatctcatgatttcatttcatctcatgatttcatctcatttcatcttttcatctcgtcattacatttcatcatttcatttcatcttttcatctcgtcatttcatttgatcatttcatcaattcatcatttcatttcatttcattatttcatcatttaatcatttaacttcatttcctcatttcatttcatttcatcatttcatatcatttcttcacttcaccgtttgatcttttcatttcatttcatcattccatttcatttcctcatttcatttcacaatttcatttcatcatttcatttcatcattccatttcatcacatttcatcatttcatcatttcacttcatctcatcatatcatctttcattgcattatttcatttcatctcatcatttcatttcatcatttcacttcatctcatcatttcatcacatcatttcatttcatctcatcatttcatttcatcttttcgtctcctcatttcatttaatcatttcgtttcttttcaccttttcatctcatcatttcatttcatcaattcatcatttaatttcattttttcgtcatttcatcattcacttcatttcatttcatcatttcatacatttcctcaattcatcatttcatcttttcatttcatttcatcatttcatcatttcatttcatttcacttcattatttcatttcatttcatttcaccattttatgtcatcatttcatttttcatcattccatttcatcatttcatttcatttcatcatcatttcagctcattatttcatttcttcatttcatcatttcgtttcatttcatcatttcatcatttcatttcatcatttcatcatatcatttcatttcagtgatacatgtatttaattgctaatgcgatgcccaggagacaccctatttccctttctaaaacacctccttcaacaaaaggcaacttctcatggctggctaagtctacagggatagcagcctctcctcaaccacccaatttcatttaaaacctcaaacagcacctcagtttcataaaaacctaaaacataaacacaacacttggttgtaagtgagccgacagtttcttgtctctttctctgctcaaggcttaaggctgtgtctccccaactacattcagtggaagagaagatcccatggacaaataagtttgagaattgttgttgcaggaattctcagaactttcaaaacacaaatcttcatccgcagggatcttcaggagggagatggctgatgcagcacaactttctttcagaggagtatcttgcagaatacagtatgagatacagaaaggctgcattgagtctttttaatggcccgggccttggtgagggtggggtaggagctctccagatagcatctaatgagtaggaacattcaggtggcttttttttttccttattcgcaaaactgtgtgtacaccatgaatgaagctggtctcccttatccacgtcaaaactaaacctaaattaattggctaaattgggactcaacacctccaggagccacgcggcagaaagccccaacacactttaaattagcttgcctcatcatatttgaggaaagcaaaacgcttatgaccagtatgctgctaatacaagtctacagataatgctgtatgaaaaactagttttcccaatcatagctggcatagtccacattttgcattacactttccccccctttttttaaattttaaacacaggtctttttctcttctttttttcaattttaattaaattatacaagacggagtctcagtatgttgcccaggctggtcttcaactcctgagctcaagcgatacaaccgtctccgcctcccaaagtgctgagattgcaggcctgagacactgtgcctggccttaaacacaaatcttaattcattcttacaattattctgaggttacaaaaatggaaggggaagaaaaatggcaagtaggtaggctgacttcggcttcattatttggaaggacagtttgctcggttaaaacacactactgcctacaaaggccaagacaacagaaaaatacagacttacataaatagattttatatgtgacagcagtttgaatggagactttttcaatgcaatgagaaacagctgtgcttgggaataaatgacaacgaattttttttatctcaacagctgtcctgagagcatgtctctacatctctacctgcattctggaatcagggagaaagccaaaacggacggcaagacactagatcagccgtgtccaaccctttgcctacaaggacttttccacctatctgtggtggtgggtagcatgaaaattatgcacaaacctttttttttttttaaccccatcagctgttttagcattagtgtattttatgtgcggcccaggagcattcttcttccaatgtggccctgagaagccaaaagactggacacctgtgcactagatcaaaaggccactccttctggaagcaattgtaaagaatttctgacattatcttgacatgaaaaccaatgggtagtgggacagaatgcaaaatcttgaagaatttttcttgtcttttttttttttttttttgagtcacggtcttgctctgtggcccaggctggagtacactggtgagatcagagctcagtgcaggatcaagtgctcctcccgcctcagccacagtagtagctgggactacagatgcgcacaaccacccctggctaatattttattttttgtagagatggggtctcactatattgtccaggttggtctcaaactccttgactcaagggatccaggaaaggataacaggtgggagccaccacacctggctatgtgcatgaacttttaagacaaacacaaggccccacaaaagttaaggtttttcccacctaatttccagggggatcttttggtgcaaggctgagaagcccttaaaagtacacagacaactccaaagattcaagacagttcatttgggctgagccagcccactgggcagactgaccttccaaaaagacccacccatgacatacaccagatggctctccaagaatctcttcagtcctcagggtccctaacgtactggacagagctaggaaagcaaacccatttgcttcttcctgcaggaaaccccttgaggttaagaccccacaatcacatgaggatggagtggctcaccctcagtcaacaggccagactcaaggtggtataatgtcttaaccacgggtgcgggcctccaggtctgactcccaactcagttcttctttaataaccacactttgttaattttccttaacaggggttcctggcaagtcatttctccctcaggccttcggtttcctcacctacaagatgagagggctggaccagatggaaattcagggggtaaggggatgtcctcacgcagcccacccccacccccacgggaccctggagcctccatcccagttcccaccacgcacccgctccacaaatcctgcccaaggtgagggctggtcctgggtcctctggctgccgcatcagcgagtgcaggagggaggggaagcctccaagggggtgacgtgggctcaaagatgcaactcggccaggagtgaactggggccccgaaggaggtgtccgggccgctcctggagcccagcccgggtccccgaaccccttacctccagggtctgtatctcctgctgggtgaggtcgttggacacagcgcacttggtgcacagcccgcacaggctgccaatgaagatgacgatgagcttctggagctgcccgcactgctgcagcgcccggctggccgcagcccctgtgccaccctccgtggccgccgcatcacccccaccaccgccctccttcttctctcccatcgcctccacaggcagcgccactctatgcaggccacaggggcctaggcaaggagcctggggcgccggcgcctaggcaaggaatccctgagccaggagagctggaccaggagcacccctcagagctgcccttgccaggacgccagtagagctggcagccgagtctgccgctcccgccctcagagccgtggcggcggggacaaaaatcctcggcggcgggggcaaaacgccgcggcggcgaaaaagtcgctgcggcagggggacaaaaagccgtgacagcggggcgcaaaaagccgcggcgggtaaaaggccgtggcgagtaaaaagccgcgatggcaaaaagccgcggtgggcaaaaagccacggcggcggtggggcaaaaagcagcggcggtggcggaggggcaaaaagccgtggcagcgagggggcagaaagccgcggcggcaaaaagccaaggcggcgagtgtgcaaaaagctgtgtcggcggtggggcaaaaagccgcggcggcgggtgtgtggcagaaagccgcggcgggcaaaaagccgcggcggcgaggggggcaaaaatccgcggcgggcaaaaagccgcggcggcgcggggtaaaaagccgcggtgggcaagaagccgaggcggggtggaggcaaaaagccgcggcggcgggtggcaaaaagctgcggcgggtaaaaggccgcgggggcaggggggaaaagccacggcggggaaaaagccgcggcggcggggtgcgaaaagcggcggggggcaaaacgcctcggcgggcaaaaagccgaggcagggtgggggcaaaaagctgcggcggcgggtgggtggcagaaagccgcggcggtgaggggggcacaaagccgcggcgggcaaaaagccgaggaggggtgggggcaaaaagccgcggcgggcaaaaagccgaggaggggtgggggcaaaaagctgcggcgggtgaaaagtcgcgggggcaggggggaaaaatccacggcgggaaaaagcggcggcggcgagggggcaaaaagccgcggggtgccaaaagcggcggggtgcaaaaggcggcggggggcaaaaagccgcagcggcggggggcgggcaaaaagccgcggcgacaaaactcgcaacggcgaggggtcaaaaagccggggcggactaaaagccctggcgccggggcggcgggggcgcaaaaagccgcagcggcgggtgggggcagaaagccgcagcggcgatggggcaaaaagccacggcggcgggggtaaaaagtcgctgcgggcaaaaagtcgcggcggcggggacaaaaaggcgcggcgggcaaaaagccgtggcgcaggggggacaaaaagccgcggcggggggtggggaagccacggcgggcaaaaagccgcggcggcgaggggcacaaagccccggcgggcaaaaacccgaggcggggtggggtctaaaagccgcggcggctgggggtaaaaagccgaggcgggtaaaaagccgtgggggcaggggggaaaaagccacggcggcgggggggcaaaaagcggaggggggcaaaatgccgcagcagcgggggacaaaaagccgcggcggcaaaattcgcagcggcgaggggtcaaaaagccgcggcgggctaaaagccctggcgccggggggcacaaagcagcggcgggcaaaaagcctaggcggggtggggggaataagccgcggcggcggggggggcgggaaaaagccgcggcggcgggggggcgggaaaaagccgcggcggtggcggcggagggcgaaataatggagatggagtggaaggccggcacagcttggcattgctggagtgcgatgtgataggaaatgtgcagccaaagacaaaaagatgtaagtaggcttgactcattgaagctaagaacccagatgttatcttgagggtattaactaataagcagtttaaatcagaatggcacattctgatttgtttcttgtacgttcatatttggcaggcatagatactgtttgaagagagaaaagtcagtagagagaggtaacaaacttaaatatgtgccaagtctagaaacaagagaccagggggatagggacctttcaaaataaaatgcaagatttgaaaactgattggctgggggatgaggaaaaggcaggtctttaaggtccatccctgttttgctttaagttgttagggggtggttttatcacatgttgtagaatatgtcatttcagttttgaacatcttgagttaaattgtcctagcatatcttatgaatttgattttcttccctggaaagctaatatttcaaacacttaaagagtatatagatttccaacttgtatccagtttataaaactatctctaggctgctgatttcaggaggaggcttatgagtattctccttgcagagaatatatcaggagttaacagcagcttcaatatttgtggatgaccggttaactaagccacctcttagtgtctttagttgggaaatcttagctgaagatattcaataatgaaccaagagtgactaagaaattcaatatttaagtatatttcattgtaattaatttgaattgaagtagccatatacagctagtatttactatattgaacaatgcaaataagaggaaaaaattaataaccatctctaataccacaggccaaaatcctcatcaatttattctagctaaaggagttgatcagaagcagtagttgaaagcaccaactaaacccagctggggttagttcactgtcattctctcagaaccgtctcttctctgaacaaaacaagtacaagagttcattgtgaatctgcattctccttgcctattttaaggttttgatgttgacgcaaatttgtgaaatccctcctgtggtgtgatatttcgttttccttgctttgtgttaggacaagaatgcttcagctcttaatttaaaattatgtttctccctcctaggttgagtgaacttagaatgcattctctgacatatccaagattttgttaatatgaatttcgggaaaaaagcatacttaattagctaagacgtcttattctaagcttgaccctatgttcgacatcttttgaatttctggttgcgtgggctgctctctgacactggttagtgacctggaagctctattaatgttaggggaggtggtgtatgagcattagaggtatccttgcaaggaaagacttgtcttatctcaatacgtctttttttttgcacacaagaaagtcaatgtctgagtcttctaaaatcttcctatttccaaattgcagattatgattgattcctaaacaaagacctaatttttgactcagagacgtggcaagctagtgaatcaccgttataatttaacaatcttcaagataaaattatctctgatatttagattttgcccaattattaagatatttgggtgtttcgttaagaatggaaaactctagtctcttgagcagagactataaaggcctcagatgatcatttttaattttatgctcttttctttaacaccttcaacacagttggaagcagccgatattccgcagagttgttgtgttttttaaaccaaatgcatggttcagtggtagaaaactgggctgatccaagctgttttcagtaaacacttcatttcaggtgacccatttcgtattaaataatctctagatcctgtcttcgaaactaactagatcagataaactaccctggattttctctttttagggtctgagagctgcagtcacttttgtgaaaatgattacaatgacaagatagagttgtagatggggaaaatgttttgactaatttaagcatagtggtatttcatatgagaatttaagttacacacatttgaaaattataatggagtctcttggctgagctttaaaaagaaatagcgtttaggctaaaaagggaactgctacctctcctaaaatcagaaagatgttacagtaattctccattctctagaattatcaagaagcacctttgtgatgatttacttttgctcttgcgactgtgagcccgtgtagtcgtggaaccatcaattagaatggttgctttctgatcccaaagtcactcgttctgaaaacaatatttttcataaatttgaaagtgagaagttttgatcttgccattcccaagtaactctcttaataagaggcatcagcatgcttcagtgacagctgtcaccttccattgctgagagtcatctttgagttctctatttcactccctacactccaatttagctgcagttctcttggccagtcctatgaaatacatccatggcctaacaacttctcaccactactaccactcatgctgacagcattctcacctaagtcactaccttttttcactggattagagtagcctcccaatttatttgctcacataacctatttattctacacagtgcaccagatacacccctttgaaatgcaaacacaatcatattattctctggtgaaattatctcatatattcctatcgcatttaaaattaattcagaatcatcccatgattatcaaaaccctacatgctcttccacaacatggtttacttccaagatatctcttcaacatttttttcactgtactgaattggtgactaatagtcatatttttgtttttgctcaaaaagtcttgacttgtaaatttttcagtttctcctttatccacaggtaactctttcctgataaggcgaattgcttgcttccttgaattctgctctcaaagatacccttcactttctacctaatattaataactttaatcattcattattccattactatgctctatggtgtatacaatttctgttctttgtcatgttattaactaaattatttattgggtccagtaacgtattccataaatattgtacacataaaaattgtgttatttttattcctgtatgctgagctgcccaataacagtctgaggattaacatatttgttaaatgcacaaatacattctttcacaaatattagtttaataattttatattaaactccctctatacttacaatatgaattagataattcagaataaacattccattggaaaaagctacacaatttgttataaaacatccttaaaagcatcagaaaattaatacagcaatgaagaattacaggaccaaattaagaatggtatgaaagcctgtttgtgacgcttatgtttgggttatctctttatttgagtgactataaatctcaaaagagaactaaagggagaaataaccgtatctactaacatgctaagggtacttaaacatctcttagtaattgagaaaattgaaagaaaagaaaaaagagaaagggagaaagagaaacagcgaaagggataatgaaggagagaaagaagaagagaaaggaagaggaagaaaagtaaaaaggaggaggagggggaaggaagaaggcacaatcacagctcactgcagtctcgaccttccaggctcaaatgatcctcccacctcagcatcccaagtagctcacactacaggcacccaccaccacaccaagctaatttttattttttttgtagagatggagtctcactatattgcccaggctggtcttgaactactgtagtcaagtggtcctcccacctgagcctcccaaagtgctgggattacaagcataagccaccatacttggtgagatatgaatttctaggaaaaaaatcaaaattgactcaaaaagtagaaaaaaaacttacatagattaaatatattgaatcagtaatgaaaaaacttcccataaagaaatttccaggcccaagtgccttcaccaaaaagttccatgaaacatacaagagaaacaaaccaaccaaccaaacaacaacaacaaaaaaaactctgccaccaacacagagaataaaaaaagaagactcccgagttcattttacaaggttaaaataaaaataaccttgatatcaaaacccaacaaggcaagtgcaagagaaaatatttacaggccatcattattcaacgtggatcagcaattatttttaagatgtactggccaggtgtggtggtcatgcctataatcctagtattttgggaggcccgagtgagaggatggcctgagctcaggagtttgagaccagcctgggcaacaaggcaaaatcacgtctttataaaaaatacaaaaattagctgggcatggcagcacacctgtagacccagctattcgggaggctgaggtgggaggatcacttgagcctagcaggttgagaatgcagtgatccctgatcatgccactgtgctccagcctgggcaacagagtgagaccctgtctcaaaacaacaacagaaagatatgctgaccgcctgtgatgctggccaggatggcgtatgcatgctacggcctgtcatttccactgatcacaatttgaaactctggacaaaatataaatagcaatgacccaagtactctgaaaagtaaccagcagacaggttgggaaacgtcaaaacctgaagaattatctggatggtggtggtgagagatcatattctgggtcataaaacaaaccctaaagttaaacaattaaaattcagtgaattattttctctgatgacagaattaaactaggaatctagaacatttctagaacatccccaaatatgagaagttaaatggcatacttctaaatggcccataggtcaaagagagtatcttaagacaaattggaaaacagtttgaacttaataaatatgacatcatcttatcaaaatatgtgcttacagggcaatttatggcactaaattatgagaaatgaagcatcaaatcaataatgtaagcatttactttaagtaaaaaaagaaccaaataaactcaaatcaggcataagaaaaacagactaaatcagtaatatttaaacaaaaacagtaaaggaaaaaaattcaacgaaatccaaagttggttctttgcaagggcggtgggaggtggaagtcaatcaaatgaggaagcctctagcagactgacaaaggaagaagagaaaacacaaattgccaataccagaaatgaaaggaatattattacaaatcctgtagacactagaaggctagaatggacactacaaaaacaaaacaaacaactatatgcttctaaattctacaaattaggtgaaatagatcaattccttgaaagacagactaccgaaactcaagaagaaacagacagcttgaatacccctgtatttattaaagaaacagaagtggcacagcactttggaagacaatttggcaggttctgataaagtcaaacgtacatggaccatgtgactcggcaatcctacccttaggcatttgcacaagtgaaatgaaaacctatgctcagacaaaaagcactttgtgaattccaatccacttataatttatcaaaaagtgaaaatagtccatattcctccaatgacaaaccaataagcaaaccatgtagtatttatacaatggattactatttggcaattaaaaggaataactgttgatacagtatatgaaagtagccagactcaaaaggctacatcctgaacgattccatttgtataaaattctgaaaaaaaagcaatgccagaggaacacagatcagttattgccagaagtttacaatggaaggttttactataaagggtaaggtaatttttggagtgatcatataattttgtaatctaccaaaaacaaacataataaatgggcagataagtaaagttcatggattggaaagttcaatattgcaaagttctcccaaaaatgacctatcaatttaatcccagtggaaattccaatcagttttgtgaaggctgctaagtcaactctaaaatggccaagaatagacaagatcaccggagaggaagcagggaggtggacacaaatatcttctgattgatgagtgaaatcattagaaggccagcaaaaatacaagtaagccagaatttctaaagcaccacaaaagaacactagttagtagtgcataaaggtatctcctaaatttgttgtaaacataggcctttaaaaaaatattagaaactgatatttaaagagatataaactcatattaagcttttaaaaaattctaagcaagggcctcacctaatttcataaaaggttgcgtagaaccaaccattgctgcaaacgatgtgctgccctgagatgtgaggatcccagtggtccctctgggtcaacagcagctaccgcaggtgagcccaaattctgatacattatctatctacaatcattatttttaacaatgtatatcaatgctacccataaggcacagagaagcagaaatgtttatgtggcctcctgccaaaaacaatcacttgcacttatttctagtactccagaagacagtaatagaagtttttcaatttagaaaaacatttacagcaaagaaaaaaatctctgtaaacttcctgcttatccaatctagtgaattgtgatgagccatataaattcatttagccaccttatgaaagacttaatccaaagtcacttctaacttctagaagagctaatgtattataatcacagttgtgaaagactcaaaggccagaaatgtcaaggtgtggtctatatcctaagtccagaaaaaaaaacaaaaagcaacacgtacaggccaaatgattgccaatttcttctgcctacgtcatctttcttcactatagcctgaaattacatttcatgtttgacaattctcagcaaggagacaaaacaagcttatgagtaaaataatagaaagcagagccacagagaggacgagaggcaggagtcatctcccaagtccaagttcaacttctatattattagacaaggcctcagtgtctttgaactgcaaggaattaatattgattgtagcatgagtaaaatctatcttctactcatcatgaaaagtcacagtcgttttgtttaaagactccagaattattataggcagaaacaagcaggttccacacctatttggtgaaacgaggaatcaggaatgagcattcccaagagaatacaattacaaaagtaaaatcacctagagtttttgggctgcttaaaaaacccagaaagaagtgccaaatgggaaaataatcaaattcagtggaaaaactcacttgaaggtatcatggtcagctgggtttccacccctttgttgcacttcaaatcctgtgtattccacaaagacttgctcctttctaaaggctatggttcacattcaacagaatagcagcaaccaccatgagcctgagggctggctagtctttagtattctgccttattcaaagaaaggatcatttccctcattcctaaagatctcccaggtccatcacaaaaaaaaaaaggagcagcagccaggcgcaatggctcacacctgtaatcccagcactttgagaggccaaggggggagggtcacctgaggtcgagagttcaagaccagcctggccaacatgatgaaactaaaaatacaaaaatcagccgggtgtggtggtgtgtgcctgtaatcccagctactttggagctgggtaactggcagaggttgaacaatttgcaggtctcagaagacaggaaaatgtgggaaagtttgaaattccaagagacttgttgaatggctttgaccaaaatgctgataatgatatggacaatgaaatccatgctgaggcagtctctgatggagatgaggaacttgctgggaactggagcaaaggtgactcttgtcacctttgataagatggtggttgaggagaggtcttggcaagcagtgatgtgtgaatgtagtgaggggcctgaaaatggaactcagagaggacactgggttttagaggctgaaactacagaaagtccgctgcgttcaaggcctgcttccaccaaaatctagcagtgtggcctcaaaccatttcatttctcttggcctcagtttctacatctgcaaaatgggatttataatcccaccccagcccacagaattcagagttatatgagaaggctagaagagctcacctaccaagggactcttttaatggcaaggtggggaaactgaggcaccgagagggctagggctctgctagctgtcacccagagtctgatggacctgagatgagaaaccagaactcctgcccctagttcccccggctttcctcaggctggggagtgagtgcggtgagatagaaagggcaagccctcctgctgtttctctctggacaggggcgggatgctgggtgaagggtgaaaggaagaggctggagaagggagaaaagctccagctcacactaagtctgaattttttttaaatgcggactccgtggcccctcccttacccgccccaatcctctctgaagtcctggttgtgaggggccaagtcccaaagtctgctgctccgcctctctgtgtgcagagccatggggccttcacaggctgcagtgggtcccgagcccccagggctgtgcctgctggtcctgaccaagatcgcggctgccgaggtcagtccagcgccaagggcacagggccagggcaggcggggcagggctacccgaagcgcatagaggctgctggtgtcaacgtgacgtcttctggggcgcctggcatccctaggagtggaagccgctgatgaagtcaaagctgcctcctccttcaggaagactttgctcccatagctggcgaacaggaagcggagcagcgccaggaggatctgcgggcgctgctgagggcttctttgcagggacagtgcagcaggcagccagggacaagactgcacggcagcgccccatggccaggggaagctcagaaccggagtcgcccgctgcccggcgattctccatccctggatcggtacaggggcatttggacgctgtggggaagtcgcggtctggggatattgggtccagccttcgggtagaagcaggtgataaacgcactcaggccagcccggagcgtcagccacactgcggtgcccacgatgcccagggtgagcgccacgaggcgcaggaaattggctagggtgggagctcactggtaggcggccctggaagtcaaagatctgctgctccagcgctgccaccagttgcaggcagcagaaggcgaggagcgtgtggcacccgcgtactcgcccatcgctccgcggacctctttatccaaccttcaataattattctttttattatattcaatgattattctacttttcatagagagcagctgtcagtccaataacacacttaacaaatgatatacctagtcctcaaggttaacaaacacatgaagaccagcccaaccctgaaaatcagtttgcaaaccttcgctatatctgatgccattcctaaaaatttttagggacaagttttgtttgtggtaaacaacataaggtggggtgtgtgctgagcccaaagctgaccaattgctcacaattactcataactacccattgacttgattttatcaaacttcagacagtcttgtctcctctcctcaggcccctggaccttggctcaccacctaagactgaacaagcactaaaggacagaccagcccgctaacagctcactccaaaaatgagcgggactcccagagaaactatttttattggagcatcctggttttgccacctgctcaccccactgcctgttcttctctccaaggaggcttctgccagccctgcttgtccttccctagaaaaggaaagccttttcctgtttgatcctgagacacctgtagattgagtttggaatattctccctattgcaatagtatttttgaataagttttatttttccctacctctggttgatttttaattaataccagtaagcttggatgaaagcctgcacaccttaggtgtgtgtgtgtgtgtgtatgtatgtactttagcattatcataaagtaataacagtaaaatcaaacaaacacagatggataagcaatatgttggactagtatgaaaatggcattgccagcagtgatatgatttttttttcaaaatggtacactttttgaagtataatcttattttaacctaaaatcttactatcagaaaatgcagtgtacattaaaatgttctgaactgcttttattcatatattaaatggttgtactcaaatatctacaaatttgtttttcacttatgtaattgtcttatagaatgttcaaaagtcttgcagaatgtgagacaattttctattgaatacgatcgctttatcattgcaagacatcaaacatccctgtttcctgccaaataaatgtacaatagcaataaatgtaaagatgtgttttgtaaaaaagatatatttttgagttacaaaacaaggattttaaaacttgaattgttacagtgaatatgtcttaatacaggccagagtcatttaggtaaaaaattacctcatatctattctttacagtatcacttaaaggtgtttatttagcggcaaagatttttttttttttgtgcctagaggcagatattttgccccatggctatttacggtatgaaactgtatttaaatgagtgtacatacataaaagctgccattctggctgtaaactattgcaggttatcaagattaaaaaataaacaaataaaaatatttcagtttttctatgaaatgtctttactcgagtccaaatgtagagatataaaatgcttgaaattcataaaaccaagtgtttcacatatttcagttgtgatggcctttgtcctacttttgttagtgaagcaggcagactgcattttttccctctcatacatcttcaaatggtagacagaaaaatttgataaaacttctagggcattatctgatgaaacacattaaacactaaaggagaaatacaacttcattgtttataaaagacgtataagaaggaaacctgcatacatatatctatcagttttgtattttcaagaaatatttgccttaaaatgaacttcattagaatatgtgttctcccacagagccaaggaaagtaagttagacacaggatctggaagtctacctgtgtgatgtaattacattgaaaacattccacaaataatgcagaaatgtatcattgtgacccaaaatattctctaaattttctcaaagcaatgtggccacatctattatcttttactatgactagtcatcattccatgcatttgaacattacctcacccatttgcagcctcctatctctgcaattaattatggctaacattctcagcagtccaaacatcttgcaagtgacagcttgaaaaggcctaccagaatgatgttcactctgccacctgactagcttgtcttccatctagacattgcagtatgtagaagagtgcttttagtattataaatttgatccaacacgtgttcaattagatgaaatcttaaatactgcactacatgtgaattgggaaaatgttaatttgcttctgtagttttaagtgtattctcagaggcagatgaagacatattacatcactgagttcaagaaataaagtaaatagaagaaaaaaggtgttattttagtttggttatgtttatatttgaagttttcttatcataccttattttttgtttattaattccagggtagagtagaaaaatatgctctcatataatataaaaatgatatggggaaaagaagtaaaaaattaacttagagacaccattaattaatttcttttataaatgaaacactagatagtttctatttgttttgacaaatagataatatatttagaatcaatgctttatttcttggaaagtggagtgaaaaatttaaatgtagtattcagattgtattataactgtgcactacagatcacatacatttgtcttttctttgtattatacattatttaatggtaagcatcctttcaagggctattttatataagtagtaaggtatctggaatttctgaaataataaaagtgacctaaatcactgtgtttggtaaattcacaatacccaaatagcaggaggggagtgctagaggtagggaggagaatgctcatgttctcattattcccaaacagattcttaaagtcttctcactggacacatggatgcacctctgtaatacccaatgtcttagccacaactgtccgcactttttaatgagatacatttcaacattattccttgtcacctcaatatcagatactttctcatgtaatcttttacttctgaggagttgaattcttgatccataaactgaatccatagctatgcatctgtggatgtttttaaattatgtgaaaattttgtatatgcatttttcaggggaaagtatcagatcacccacctggtgattgtaacaaaaacaatcactcctgttggtatttaagtcttaattaattcagaaaaatttgcacacaccctaaggtcagatagtattttgtaccctacatataaaaactccttttttttttttttgagatggagtctcactctgttgcccaggttggagtgcactggcatgatctctgctcactgcaaactctgcctcccataacattaatgatcactgatcacagatcaccgtaacgaatataataataaggaaatattttaaaaattgtgaagattaccaaagtgtgaaaccaagacacaaagtgagcacaggctgtttgttaaatggcaccaatagacttgcttcaccagggttgtcacaaacatctcatttgtaaataaagaaaaaatgttcctatctgtgaagcacaataaagagaagtgcaataaaatatgtttgtattaatttggttaactttattccaacttaatgtaaattagttttaaaacagtttataaaattcttaaatgaacctggcaaatttagagcaataataaaattatttaaattagaaaagtcttttttaaaaaggataaataacaaatgtctcattggaattattaaagttgtttcaagttcagctctgaggttcttagaaactaaagtaaaaaagtatgaccagtttctgaagtcaagataaaatcatacaatctttaacttagaaaattatcttctgtgttgtgtcctaagcataaacaaatgtaaggacttgccctgacactctgtaagtagttccactccaatacgccctgcagaaatatttcctggcaagaacagcaagtcagaagccttttcagcatggcaaggagggagagagactatgctattaaaaaaaaaaaaaaaaaaaagatgaggaggaacaatagcaccttagacaagtgagaagtttcaaaagagacatataaggagagcagttgcaattataaggagcaaaatatggaatgatgaaaaaaagatactttaaagaaagttttcctcagtactttgcaatgcgcttgccaccttctgaagaaagctggctccttctggaaccttagggtatttggactcatgctttggaatggggtgaccatctacatcaagctaacttaaattcaaatttgtgtgcataggataagaataattgggttaaataaaattcacttttaatctaaaatgtcattcattagttttgaccaactttccttaccactggccacttggtccttgtcttgtttgaccagggttgtcaaacaaggtttgttgtttccttctttgaaggaaagagtcagtgtttcttccattccaatgcatccacttgaggaatttttaataaaatgggcaatgaatgggcagcagaagaagttacaggcctgctgatcaaatgctaagtaataaaccctggaaattctaaactcgtttgcatgaagaccttgcttattttgtaactattatgtattatcaaatgtatacttaattctttgaatgtgttagtatgtgttcaaagtacaccttaattttatatatatatatatttaaattacataaaataaataagccactaaaaatttttaaacattttcttatatttcctttcagtatttttatgtgcatgcatctgtacttggtaatattgctgaatgcatgtttgcattgacaaagcctctccccttgcccaaactctagttgggatcctctaagccacctctcagcctcagctttcagtgttcatcctagtctggcccacatctctcaggtttaggaagaaacttgcaaagaatcccccactctcagtactgatcacctttgatatctgatcaaatttgttatctcccaccaccctccagatgatttctgatcagtctggcctgccttcagtaagaatcctgttcgatctgtttaacccaaatcccctttgcccctgatatttcctcttagtatccccagttgagccaattttcaaccattaaaaaaatcttggacaaaattaagttcagataggttccagagtgcttatgttcagttcttggctttttgaagacctggcatatcctctttaaattgcctcaatacaagaaaatacaaaatggaaagaagtagacattagaaattggaaaaatggagaaatacaggaatgaacataagtttctatttcaagtaattaggtaaattgtaagatgtttatatttaactttttctcattggctttagccccttgaatctttgagaacatgttattactatagttatcgaatgttatattttttattttaacgtagaatggtattttcactcaaatctcttgaaacatatatttatagtcaatagttaaattttatttaatatcaattgttcctttttattagtattttcttaaaaaaataatattggcccagcgcagtggttcacacctgtaatcccagcactttgggaggctaaggtgggcagatcacttgaggtcgggagttggagaccagcctgagcaacttggagacaacctttctctactaaaaatacaaaaattagccggacgtggtggtgcatgcctgtaatcccagctactcaggaggctcgaggcaagagaattgcttgaacctgggaggtagaggttgcagtgagccgagatcgcaccaccgcactctagcctgggtgacagagcgagactccatctcaaaaaaaaagaaagaaagaaaatgccagacatttattgaagggctggaatggtatagtgaagtgttctgagtcagttgggctctgattgataaagagcttggcatgtttgaaggacagcaaggaagccagaatagctggagcatagcagcagggagacaagtgccacaagatgagctggagaaaggcactgggaaaggtttgtcttttaagtgctctgagaagcaattgaagatttgaaatagaatagtgacttgcttgatcacatttgtacttttgaaaagttcctctggctgctgtggggaaaggcttgagtagatgcagggtgggagaagcataaccagcagtagactcttgtagcaggttaggtgagagatggtggtggccacgagtgggctgctagtggtggaagtgacaagaagcagaaggatcggagacaaaacttgaagataaaaagtcttgaatttgctgatgatttgcattgacgaggtgttgggggagaggactgaaggagcagaggagagtgacaagggactggatgccatttataaggatggggaagactgggatgaaaccggttaagggagaaattttaaccatggcaaaattaagaggggttttatgtgagaaaatggaaatgctaaggaggaagttgaaaatcctgctaatttggagatctttgattaaaactagaaataagaatgtgggaagcatcaacttgcaagatgccctcattgtagataacaccatttaggatctaggctcaagccctgggaaactccagggctttggaagtcaaatagaggaagaacacgtacaggagatgaagaaagattagcgaggaagtcagtgaaatatccacaggtgggctgctgccaaatccagcagaacagtatgccagatgttaggagcatgagtaaaatgagaaaagagaaatggcttttgacaacacttccctactaatagtagggaagaagacataggtacagattcaagttgatttgaaattatgaaagtgaggtaattgacctgcagtggttgctgctcagtgaaatcagcatagtgattacctgagctaggttagagatttgatgggtaagaaagaacacctgagggtaatcctggagggggaaaaaaataaagtgtttgctggagagaatgagttggattgctggacttcaatgtgtgtgggttgagtttgtgacttaaaaatgaaaccagtctattgcttgtgtggcttttccaaaataccgttattccgttacctatctcttaccccaagagtagtcacattcttatttctggttattttaattcctggtggtatttttatgtgattaatgagatagtacttgttaatttgatgatattctagaaacctggtaagtactatgtaccttgtcttaagttttggttacttgattggtaaaattatgcatgcaccattgaattacctaattcaaaatatatccttttattgtttgacatttgtcttgtttttctttaaaatgttatctttgtggagtaaacatttttctttatgctgtttagcatcttcagattagttcagggtattgctgaatgtggttgtttggaagtaaaatgctttagttttagttatatagattttaataagatactactttctatataatttatcaggtactttaggcattttaatttgcaaatttaggacaatttgctttaacgtttcttcacttttgtccattggatgtaatttccataaagtattcatttccctgagtaaaaaccgaaaccaaaccggcaactaatggtcactgaagaaagagtgattaaatgctaagattataatggtatttgcattttaatgttaccagctctctacagtgtaaagtttatgcatttatctattgcttatgtttctcattgcattctttggcctactggttttggttgtttatagctatagaatatagaattccttatggttatccatttctccttttaagtagagtgatagttgttagaagaaaaataaccccccaatactttcttctagtgttaattcttaaagtgtgattgacttttatttactttttggtgcagtaattgcagttcatgagtcaatgttgatgtcatataaaccttaatttttaatgtttcattgtagtgatgtctctgtagcagcaaacatttaagttatttgttatacttaaatgtttaaatcactgttagtgattagcttattttgccttccttgaagcaatttgtcctaaatttccatatgtttgcatttgtttttgctgttctaaaattccttagttgctggctttgaccttttatgttgctgagttttacacatctattttctcaactgccatatcctaggaggcttggagtacccataatacagtgagcccaccttcctggtccccagacatttcaggaggtcgggaaatttttaaacccaggcagcttcctggcagtgccatttggagcatcaaagtggtaaataaaattgcatttacattcatatatcatttctgtctgatttgttttgccctactgggtgtaaagaattaaatctttcttttctagattgagcttccagaaacactttttaaatctaaaaattttaatgtaaagaaataatatgcttgcatttaaaaatcaatatacatttttaatacctctttttatggttaattccttttgttgtgattactaccggttttatgagggagaagtccttgacatgtagaccaaaaggtaattaaggaccttttcattcatgatatcataaaactttgttgcttagaaaaaagcaaaagaaaaaactccattaatttattatgttcttatggagaagaaataccaaaattgtggcagatttcattgtctgtttaataccttaaaatgacaaggctttttcccccatgacattggttgatggctgtgccagtccttgaagtgagttaagtagtgtgatgcattttgaagagaaaaaaattaatttgaaaaagtattaactcaaaagttaaaatacttcattgactggagatgacagtttttcttcatattctatatttaatattctggaatatggctgtttaattcagactaatcaaggattttaaggaattctagattatactttattttctttcatgactggaagtactatttttttttaacctccctacctccccctgatatcatccaagatattgaggtataaatatacctcatttgacagtttgataatatagaccaccaatttttacttaccttttttctgggtcagcatttcatgtttgagaaaagaaattgagagattactgtagtcttgatttttaatcactgacttaatttttcaaaaatcttttataccagcttaataacaaaacaaactcggccgggcgcagtggctcacgcctgtaatcccagcactttgggaggctgagggggcagatcaccggaggtcaggagttcgaggccaacctggccaaagtggtgaaaccccgtctctactaaaaatacaaagagatttagccgtgcgtggtggcatgtgcctgtaatcccagctgctagggaggctgaggcaggagaattgcttgaacccaggagatggaggttgcagtgagccaagatcacatcattgcactccagcctgggcaaagaagcgagactccatctcaaaaacaaacaaacaaacaaaaaacccaaaaaactaacctgaccccatctatctgttgtgcaaagaagctgatgcacttctcaaaagggatctcaaggagagcagggtaagagaagacaggagtggcagtttgaaactgggagctggctgtatttattacatccaaagggaaaaaagccattcctcccattccttttgttcatgtgtttctattttatgcttacagtatcatcataaatttttgacttggaaaccattctgctaaatagggaatcagtttatttcaaactatgataagggacatcagttgaagatatgacatattatttaacttatggtgagggaaacacctaagtattttcctgagcatctggataattttaaatacacataattcatctacttaggtaggtgccaggttttttcaaggagtaattaattagtacgaacaagggtgagggggcagggaacaccatactctggtacttaatgtctgaaattatcagggaatttaacacattttcccataggtttatttcttgtgtaagaagtcagataaattatttccatttcaagtatttattattcagattatttaaagcaaagctttcacaaagccttttgtcagctttcctgtaatcctcaaataatttttcctggctggacgctttggcttactcctgtaatcctggcactttgggaggcagaagcaggaggatcacttgagcccaagagttctaggctgcagtgagctgtgatcacaccactgcactccaacctgagtgacggatcaagttcttgtctcaaaaataaaagtaataacaataataataaattttcctctaaatacaatggtgaatgaggtagaaatgttgagttcataagagaactgttgaatagtgaaggaaactgacttaattttaatgacaggaagaatactgttacacactagcaaaaataaactttcatgctgatgtagcagtacagaatatgcttccaacccagggacgctggagccaggcttgctagctaagcgaccttggacaagttacttaaccattttattcctcagcacactcatctcaaacgaggataataaaacctactatatgggattgttgagagtaaaaaatacttagattagtacatagtaagtactcaatagatgttagctattactgtaatcaccgcgagaccagttaatgagagagttcttccttatccttactctatattgaatacaatttgttgcacttcgaaatatctggataaggctatagttgttgtcgtcaccgagaatgtaggagtggcaaagagaaaaatcatgcaaaggcttgctgatagcgttcacagtgacagcccgaaagtatgattctaaggttgtaagcattttatatttagaattttaagttgtggaatatacttttaaagataaaaataataagccaggtctcttaatacttatctaaagaagtgtttgtataacatttaataaaatgttttatctcagtggcatttggatttaaaaattattttgggctgtcacagaatgttgacttttcctaatctgttacatagggccatgggtctggatttccaggaaagcggagacctcgaggtgcaggactgtcggggcgaggtggccgaggcaggtcaaagctgaaaagtggaatcggagctgttgtattgcctggggtgaggcttgcttcatgtatattttctctaatctaaatgtcagttaatgatgaaaatctcatagcaagttattttgaacttaaaaatcatataaataggtcaaaatgtttattttactgtcctactttgctttttttttttttttttgagcctctggttacgttttcttgtatatttactttctcatcctttctcttttcttaccttcctctttgactccttatctttctatgccaaccctctctaaaaagtcagtatgtaatatagttgctcttttatttaaaaaattttaagattgatatttgcttactatcatgttacgaggctttatttatatgtgtattacaaatatatttgttaactactagcaaatattttatgtaataacttcgctattttattaaaatcctgtttttaaaattctgaaatgtcattttaagtataggagacaggtgaaattgttcaagtttactactaaaccaggaataaggaagcttagattcttgtccttttttcaaaaagaaaaattttaaaaccaggcttattgaggtatagttgatataagctatatttgacatgtacaattccataagctttgatatatacatatacacccttgaaaacgataccacaatcatgatagtgaatatattcatctcccaacgtttcttcatgtccctctgtaattttctgcattccccctgccatccgtccttgtccccaagattagtttgcattttctagagttgtatataagtggaatcatacagaactgtgtgctttttggactgatttatttcagcacaattatttggagattaatctatgctgttgtacttgttaacagtgtacttccttttcttgctgaatattaataaaactgtggatgcaccacggttgtagacctgtgcactttttttcttctttttttttttttttttttttctgagacaggttctcgttctaattcctggctggagtgcagtggtgcgatcatagctaactccagctttgacctcccacctctgtctcacaagtagctgggaccatagctgtgtgccaacacacccaactacttttttaaaatttttaatagagacagcatctcactatgttgtccaggctggtctcgaacttctgagctcaagcaattttcccaccttggcttcccaaaatgctgggattacaggcgtgagtcaccatgccccagcctgtagtcttaatttcttgtaatgtcttcatctggttttggtatcagcataactccagcttcatagaatgaatcagaaagtatattctcatcttcagttttctggaaaagttgtgtagtagtggaaatgtatcttcttatattatacatgaatttattagtgaaaccatcttggcctgaaattttctttgtggggggtttttgttgtgttttctttttttttttcttctttcttttgagatggagtttcgctcttgttgcctaggctggagtgcaatggcacaatctcagctcatgcaaccactgcctcccaggttcaagtgattcccctgcctcagccccctgggtagctgggattacatgtgcctgccaccatgcctggctatttttttttttttttttttttttgtatttttagtagagacagtttttcaccatgttggccaggctggtctcgaactcctgacctcatgtgatccacctgccttggcctcccaaagtgttgggattacaggcatgagccaccatgcccaggctggagtgcagtggcgtgatctctgctcactacagcctccacctcccaggttcaagcaattctcctgcctcagccttctgagtagctgggattactggcatgcaccaacatgcctagctaatttttgtgttttgggtagagatggggtttcgccatgttggccaggctggtctcgaactcctgacctcaggtgatccatctcccaaagtgctaggattatgggatgagccactggtgcccagcctgtgggacagtttttaacaacaaattttatttctttaataggtacctatttaggttatctgtctctccttgcataaatttgcacctttcaagaaatttgttcattttgtctatcttgacaaattaaaggaatggagttgatcataatgtttcttattattttaatacctgtagaatctgtagtgatttcaccttcctcattcttgatactaataatttgtatcttgtcttatttttttcctgatcagtctggctagagatttatcaatcttattgatcttcttgagtcagcctttgttttcatggacttttctctattttctttcccctttctgttttattgatttatattctcatctttattttttcctatcttctcactttgagtttagtttgatcttctttttttgtttactcttacgtgtccctgcttggaagggacacttgtgaagtttaggtcagagctttctattctccttggcttatatctgtggtctaggaaaatgaaatttctatcaccttctggataaatcacactattatctatgcaggcaacaatagcacatattttctgaaagattacctttgccctcaagttaggttttatttttctagcagtctaaaggtcatgaaataaattataaaataaaaacagtgggtcttcaagctagaggatactgttttctttcttgcatggacaattattttaaaatattttggtttttctgcacttattatttaaatatgactccccacccccacttgaatctagggacattgtagttttctactgcagactttgtttctggtttatactgggaatatattgtttatcattttcagtgaaagcatccactggttaaatttccttttaaaaataataatggatctttacaatttctttgagctgctcagtgtgtataatgtgttgaattttctgttagtggttgggaggtagaaatagatactttatctctattttagccatttccataattatatatctcaataaccttgtcaatgcatcattagtcctatgactgaattaatgattacttttagtagtcacttagtttcttactggtgatgatgattctacttttgtgaatcatctttgatgattctctaaaatcttagaaagctaattttgttaatgctatgcatacaacacatcaatacattttctctattaaaaaaattaaagcgttataggtagatcagaatttaccattactaactcctcaagtcctccttatttccctgttaccagtttggtatatttatatattaggttgatccatatgaaattgccaatattatttctgaactgatgaaaagcagcaatttcttatgattcaacctattatatgtgcccatagactacatataatgactttgcatgtttttatattatagtgctatacctcaaatactgttctgcaatttattttttcatcaacaacgtcttttgataatttctttcatggcagtctatacaagtttctacctccctacttttaaaatgttgcgtaattttctaatgtttggatttgtcatggctttacttactccctaatgatgaatattggcattattaacacttgtagtcattagggttcatatgaatataaattgctcttataaagcattagtactatccattaaaactgcttttaggctgggcacggtggctcatgcctgtaatcccagcacttcgggaggccgaggtgggtggatcgtgaggtctggagatcgagaccatcctggctaacatggtgaagccccatctctactaaaaatacaaaaaattagctgggcatggtggcaggcgcctgtagtcccagctactcgggaggctgaggcaggagaatgccgtgaagacagagcttgcagtgagctgagattgtgccactgcactccagcctgggtgacatagcgagactccatctcaaaaacaaacaaacaaaaaaacaaacaaacaaaaaaaactgcttttaaatgtatttgtattgaaaaatactgagatatagtccttctatttagttaaccaaccaaccttccttccttcctctttttttttttttttttttttttgagacagggtctccctctgtcacccaggctggagtgcagtggcgtaatcttggctcactgtaacctctgcctcctgggttcaagtgattctcctgcctcagcctcctgagtagctgagactacaggcgtgtgccaccacgctcggctgttttttgtatttttggtagagacaggatttcaccatgttgcccaggctggtctcgaactcctgagctcaagcgatccacacactttagcctctcaaagtgctaagattataggcatgagccaccacacccagctggttaatctttcagttgttcctcaagaaaagtaattcagtcgttttatgttttgaccttgaacataacctgttgtgtttcaactctgtctttccaggcttcggttgtaagctttttaaagaaagaggattgtattttatgattttggcagtgccctccttgtcttcttctacaacttctagttcagagctttattttgtttcatatcactctagaaattattaacaaaccagtggctacttagttgatttagtcaaatagaactaagtccagactgaacaatattggttgataatcatttggctgatactgaaatttggatgttattcaaaataatattctaaagcggtgctaatagaaatataatgagaaccacatatgcaatttaaaacttcctagtagccacattaaaaagttacagtgagctgggtgcagtggatcatttgaggtcaggagttaagagaccagcctgaccaatatggtgaaaccccgtctctactaaaaatacagaaattagctgggcatggtggtggacaactgtaatcccagctacttgggaggctgagtcagggagaacagcttgaaccaggaggcagaggttgcaacgagccgagatcgcgccattacactccagcctggtcaacaagagtgaaactcctctcgaaacaaaataaaggttatagtgaacaggcgaaattaattttaatgccttccattttgaccgatatatctaaaatattaccatttcaacatgtaatatgtaattatgtgctgtattttatgtttgcaggacatctcagttcagactaactacattgcagatcccaagtgtgtgtcattaaaatagtgatagatttgtggtgtacatacctataatattatcatttatagtttcttgattagaattctgcataatcaagtcttactaagacaggtttattatattttctcattacttcttggtccaaaggaattctacctctaaagagagaatgagttgaataataaaatgtcatgactccattttgctgtagtatcttagcattaatatttggaattgttattctagaccttagcaaaaatatatgttttgattatgaattttctgaagctttccagttaagtgtaaaacaagtgaaaaatataacttcgtattttgtgtattttgctttttataggtgtctactgcagatatttcatcaaataaggatgatgaagaaaactctgtgctcgatatggttgtgttgttttctagcagtgacaaattcactttgaatcaggtttgaacttgacaatttactgtcttcctcattgaattcctccttgcacatttctgctttatctcatatacacagaagtgatccaatatttagctatagagctatattagttaagaaggtatttttaaagtaaaatttgtaggtttttagcttagtctccatttaaaatatgttctgttttcttaacttcaggatacatgtgtagtttgtggcagttttggccaaggagcagaaggaagattacttgcctgttctcagtgtggtcagtgttaccatccatactgtgtcagtattaaggtaaacatccttaaactgagttaacaaatatgtattgaatttttatttggttttagtagtaacatgagctcccagttctcacaattaagtattatgattattaaacatatgtgacagtatttaagtactttaaatactgcttttaagggtttcctatctcaagaaatttgctcctctataaatcttatattgtactaatatcctgcttttgtcttgaaaaagtaaaacataaaaatatatgcatttaatttaaaagacaatttatactattcacaaagattttaggtttagctgattcattttgtctgttgacttataaagctgagaactggagtatttagtaaaaaattattatcccattctgttctttcccacattctgtctcctctgtgctcactcatatacaaaatgacattttctccttatagccaaaagaaagaaaacaagtgtcatatttaatgcaatcggtaataatcgagagtcagcactgctcactttcaagcatttcaggatagaggctttctggggaaccttttaagtggtatcgtgtgcttggttttaaatatggacaggtctcaatacttcactagttgtatctaaggttcttggttttttctttttaagaactcagtcttaataaaacttacatatttgaataaagtgtcatggccactggaagcaagcatggaggtatagctgtacagcagaggtcttaaactgtatactccacaaggaaatcttttctagtattgccataccatgtaatataaatactaacctcagtttcaataataggttgtgaaccatgagtgatttttataccattctcccctgcccttcagacatcactgtgttatatcattgtcagtaaaatgtcagtatagtaagcaaatcaacattatctccttcagaattctttgttgataactacactagtatttattttatagggtaatacaggtttttgtgaatttaggaatcaaaatgaaagattgtaattaatactatccaaaatagaagactagtacggttaatttctgtagttttttaaaattagttgctcatgctatgtgactgaaaaacacagagtatataaagccaattaaaaatggagttatatatgcataaaacatgtttcttttcttctttgtactttatattctgtataaaagtagctgctatcattagattttgttttttagaatgcttaatgttttggacctaaggaaattgaataagatccctttcaagatagtaatgtatttcttttaacccatccaacaattaccgaattcccattttacagatgagtacgacttacataagttaagattggacaattagtgcactatcagacacctagttattcctgtttttaaaaattatgtgtggttccttttacatgacactgttttggacagtatagaatactgcagtctcattgagaaatacagcagtatctagaaatatactagggatatatgaattggctcagcttgcatttttattgcaggaggcaattgtttgtggataagtttgatacctttgaagcttctttttaagcttgctggggcaagtctagaaagccttcactctaaggtggatattttcaaactttatggttttagaaccttaacactctttaaaattactggggacgccatagtttttgttcatgaggattttaactatggactattcagcattttagaaattaaaactaggaacattttgtaacacaagactacagaagcacaacctgtacaatgtcaatgtaatattatgatacaacatgtagcttctataaacaccactgtataattgtgaataaattaaagtgaaaaaaggcaaattaaatcttagtattatttaaacttgttttaactttacagacccactggggttccctagtccacattttggtagctgcagtcctagcattagtttaaccctatacttaagacttggcctttctgggatcactactgaattctaccccctgttcaccagtgtctttgtactctgactggttgtgcttcacttgtctttgagccttttgcaagctctggtaattgtgcagcttacacattcccagtagatgtactttcccctggttgtgggtctttgggcttctagaagtacggcttggtgttccaccaaagacttcaggggatcctttgtagatttctggagctcttagtccttattgcttcttcattttgagtactgtgtcctgcaaattccactgcctcgcctcccctaacctcagcgaggccattgattgtactctgctgaggttctccctccctgggcagcattctggaaaatgtttctaggcagaatatcataggactccctgagtgtttccttcctctcagagaccactgtctcctttactatgtgttgtccaatatctgaaaacagttgtttcatacactttgtccaattttctactatcttatgggaaaacaggctggtcccatatactccattatcgttgaagcatgtatccgtattagattataaaacatatctgtaacaactttggacatggtaccatggatggaatcctggatgacatcttatttgaaaaaacttttaaaactaaggctaaactggttcaatggaagaaaaaaatgatagtacaaccccagtacctaagttaaaaggaaatttcaaagacagagaaattgttgaagtgttgaagtactagaagtcaagaaacacaaacactaatgtttccattagatttgagaataagaaggtcttgacaagcctggcttaagcagttatgagtggatgtgggtgtagagaccagactgtagtgttttgaagagtgaatataagcggagaaacttgagagtttggttgtaaaagggaccacaggtatctgtgaagaaaacttagtaggaatgaagataaatattttaaaaattctgccactaaacacctcagatctgtctgccactttgtcttcaggtcattgtttaagccagggtcaggcagactggcccatagactaaatctggcccatttcctgtgtttgcaaataaacttttattgaaatatggccaagttcttttgtttacatatatttgtagcggtttttgcattacactggcagagtttttgtaaagttgcaacagatcatatggccctcaaaactttctgtttactctctggccctttattggaaatgtttgctggctactgctctaagccaccctgatcttaccccaggccatttccttcatttgggcaaataatatactaacttggtaatctaagacaaattcttaaaaatcaataagctaatcaaaataataaatatacatgtttaaaaatcaaatgacattaaaagcctcgtaatgggccaggtgtggtgcctcacacctgtcatcccagcactttgggaggccgaggtgggtggatcacttgagggcaggagttcaagccagcctggccaacacagtaaaaccccatctctactaaaaatacaaaaattagccgagtgtggtggctcattcctctagtcctagctactcaggaggctgagccaggagaattatttgaacatgggagctggaggttgcagtgagctgagatcacaccactgcactccagcccaggcaacagagcaagactccatctcaaaaaaaaaaaaaaaaaaaaaaaaggccttgtaatgagcaaccaactcttgtcttactctacgtccacatctgagggaatcacttttaatcttttcaggtcttttttcttgtggttaatgctatagctctaaataatcaactggtttactgctttatcaatgctagattttgttgactttctgctgtgaataaataaattctgatttaggtcttaaaatacacctccttccttctcccaatatagttgtattactatgtttagttcaattaataaggtgttggttatgactcagtaaatgttcactgcagatctaaacagtatactatgagtttcttttgtctttcatggagtttttaataacaagaaagtaatagtgactctccattcgtactttgtttttgcctactatagaactatcatataagattattttttaaagtactgtttttttctgggagaagtcctaccctctttctagacattcccttctcctgctctgatatgtgccagtggcttctgggtgtgttgttctcatccttaaacttccctggcctgatgtcctttgtcggatctgttgatttatagatcccaagtcttccttttctttgtaatacatcctcattctgttctgcatatctctaagtaactttattagaaggagaatgaaggagctgaattttgagtcttcctgtgtctacaacgtattctgtcttcacacatagttgcttgtgtagctaggttgagaattgtactttgaaaagtattttcctgtagaattggaagattatactcttctagcatctggagttgggaagttttgtgccattctgatgggtgttcctttgaatttaactcttttattttcttctctggtagcttttaggctttcttgtacctcatgatctgaatttttattctgtaccctcattacttgctgtttcattataatgtgggcacttgattggttctgtctgaggatcctagtcttttgagatctttaagaagttccgcaatcttaatattacatggtgtggcttccttcaggagtttgttagggatttggaaattcccaaatattctgctaacttatacccttgagagaggggagaataaacagaggagtgaatgtgaacttcagaattcctagcttcatagtctaaatagaaatcttctaagatcataaaatgtccctaagaactcatgctttacattattttttttggtattttttctattgattctaagcatggaaatgtagatggagattttgttgatgtattttcaaattatgtatcaataatagtgaagcttacttgatttctttaaaatctggtcactatatctataaatacagtggacattaaatgtacagcataaggtaattatgtggactttaaaaaggcattaaaatatgtgccattttctattattctgctcagtagcctcctaaaagcgtgtatgaacatgcccaacccagtattgggcctccgtaggcgctcaataaatgttagttgattgcccctttctgcttctaggtacataagcaccatattaatttatatagtatatttgattatgttaggttaatgcataaatcacatggattggttgtttcttttacagatcactaaagtggttcttagcaaaggttggaggtgtcttgagtgcactgtgtgtgaggcctgtgggaaggcaactgacccaggaagattcctgctgtgtgatgattgtgacataagttatcacacctactgcctagaccctccattgcagacagttcccaaaggagactggaagtgcaaatggttctctagggtttgtttgccttgttagtctttcaagttcagagctttctcataccactttagtttttaaaaattagccatacctatttaattgaataatacacatattctatgatagataccactaatcagaaaaattttcacatacacattaaatcatttgccccattatgttcgtatgtagcttcctgaattacagtaactgaataactaagaaaataaaattgagacttttcggggggatttggatttcaggtgtgtttggtgcagacactgtggagcaacatctgcaggtctaagatgtgaatggcagaacaattacacacagtgcgctccttgtgcaagtttatcttcctgtccagtctgctattgaaactatagagaagaagatcttattctgcaatgaagacaatgtgataggtattgtgctattttttcatctttttaaagcttttctctttgaaatgtagcaaaaaaaaaaaaaggaaaatagcttttccttaatcacaagttttaggtacagagctttttgccttgtagatttttagtcacctagaaacttacagaattgatttcctgttttgaactctcaactccagactaaagttttgttttgttttgttttgttttgttttgttttgttttgttttgtttttaaatttacagacagagtcttgctctgtcgccaggctggagtgcatcggcgctatctcggctcactgcaaactccacctccgcctcctgggttcaagcgattctcctgcctcagcctccagagtagcagggactacaggtgcatgccaccacgcccagctaatttttgtatttttagtagagacagggtttcaccatgttggccaggatggtctccatcttttgaccttgtgatccacccgcctcagcctccctaagttttatgattataggtgtgagccactgtgtccacccaagactgaagatttttaatttaggcctttttgagggtttaggaatcccttgaaattagatggagaattattgccttcatctatgctgtttcttatgaaggatttctgaatcttttaatagattataaaaaatatctaacactttctgttctccttaaaccactttctctagaagctctagatactagatatctaggtattagatagcaccttctgccctccctacgtaattatgtggaatttcaaaatcaagaatgtttccttgctttcattggtatattgttgtactctttagaagttaagcagtgaacatatattgatagtattattttatcagtagtacagtattcttgggactctggctactaattatctgttccattgcaagacaactttttactttatttcccaattaccattcaacatcgctttccatgatatatgtctacttcaagttagatgcattgcctggagcccatatatgctagcactgccatttgccgttttctgaatacctttgtgtttgccctaactagcttccttgctgtctttgaaatatttaatatatgatgataaaataattagcttccttatgtaatgtgctttgcttcctctctaatagttgttctcattcctttttatttcctccttagctctatgaaagtttttctgttaatagggatagttaggagaaaagggcaaggtaggaggagcatgtgaggcttagggcttttaagtttgatgactcagtgttacaggttttaaaaggtagcagttctcagtatattccattttttttaaaaaaatgtacaaatatggtctttttagatggatgcatgcagttcgtcagaacttaaatactgaggaagaagtggaaaatgtagcagacattggttttgattgtaacatgtgcagaccctatatgcctgcgtctaatggtaagagaataatttaaactgtgagtctgcactcttgtaccactcacttgcaccttactgtccataaccaatgaattagcttagctctactctattttgtctttgtgaaacttactttgacaagtattttatgaaaaatattattgttggttatacatgacttatcacaacttgttataaaacaatttacatgaaacaataaaaagcatatactttagatgtaaactataattttgcttccaaggaacatgatcttgtagttattgacaatatgttaaaatccaatgtgttgattctttcttagccaggttttcctccatgacttgagtatttccttcatcacttcttgttttgttgttgctttaaaaagtgcttttaactttagtgttcaaacatttattttaataaaatgagtatagaaacagaaattttaatcatatgtaagtatgtaaatacactctaccttttctgaaaagaattacatggatttttttttttcatttcagtgccttcctcagactgctgtggatcttcacttgtagcacaaattgtcacaaaagtaaaagagctagttaaaatttgaaatgctttacttaatttaattaatttactttgcttaatttttacataattggcttaccacttgtaaaatctgcttcaatcatatgggtgttctatccaaattctgtaatgttggtaatcatttccacaatgatatataaaatgtcatccagctttactggggcagtattcctataaatttcagcaagttggcaacaaaaataacagctcttagaataaccattaatgccatacttgctttggtttcattgatatattactgtgcttaattatcagttagcagaaaatacggcctagttagcaagcagatttcttttagaattaattcaatctcttaattttttaaaataattaataagcctagtatggtgattaatatgatattcttattaaacagtcattcttttgaatacttgtatttaatagcacctgatacaaaaacatttggatagtacagaaattgttctaaggaacaacagttttgtacatttaaaattaaatctgcaggatttgtacttatttattacttctccctattagtaattatgttgatactctgatttttccagatgagcttctggagtattctctcttctcttgtgtaaatagatccctgccttttgatcttttccaggaaaaagctcatagtggattagctgagcattgcatatatttgcagtgcttctaactctttttattgggacatgaacataaaaatgccaggaagacttttttgagacggagtctcaccctgttgcccaggctggagtgcagtggcacgatctcggctcactgcaacctccgcctcccgggttcaagcgattctcctgcctcagcctcacgtacagctgggattacaggtgcccgccaccacgccgggctaattttttgtatttttagaagagacagggtttcactgtgtttgccaggatggtctcgatctcctgacctcgtgatctgcctgccgcctcagcctcccagagtgctgggattacaggcatgagcccccacaacaggcccaggaagaccattttttaaaaacatgtaacatttctgcctataatccaaggaagtttgacctattgttcctagtttttattgggtatcatgaaattaattattcatgcatttcatagatacgtaattactttctagaactacagtcacattcccttgacatgggtattttggaacagtaatcagtcaaatttaaaatgaaagtttaaatttgtattcttgggattttgtaattttagacccacccaagacttatacccaggatggtgtgtgtttgactgaatcagggaagactcagttacagagcctcacagttacagttccaagaagaaaactgtcaaaaccaaaactgaaattgaagattataaatcagaatagcgtggccatccttcagacccctccagacatccaatcagaacattcaagggatggtgatatggatgatagtcgaggtaatactaatttattttccgtgaaatatgtgtgcaagaattacagcatataaagtaacttttgaaatatgtgtatggtttaccaaagggtaaatcacactgacttagataaccccgatgtgacccttgccatctccaaatgagtgatcttcttagaccttgccttttcgggttctcttcctttcacacattttagaacagacctaccttacagaaatctcaaggagcaccatatctttgaagatcacaggtggggaaatacagaggtcttgactttagtttgctagataacgacacaaaccttctcagatactgtgagcttggataataccatgtttaagttaaggtagttgaggcatacattctagaaatggaaaagctgtcatttaatattacttcaggtataacttcatattcaccagtgtgcatcataaagtattggtttataaacattttcttaatcaaagtaaatataaggtttttctagctgaattctttttttttttttttttttttttttggttgggagacagggtcttgctctgttgcccaggttagagtgcagtggcatgatcttggcttactacaacctctgcctactgggttcatgcgaccctcctacctcagcctcctgagtagctgggaccatggatgtgggcccccacgcctggctaatttttgtatttttttgtagagatggggttttgccattttgccaagactggtcttgaactcctgggctcaagccatctgctctgctcagcctgctgaattcttgagatagcaaaatattttaatagtaacctaaaatccaatatgaattaaagaggattactgtaggtttcctcatttttggggcagttatttattttcaactgattcagaagtgaagtgataattatttctgttccattacattttatttcatagctttttttttttttttttttttttttaaggggcagtgtcttgttacattgcccaggctggtttccaactcctgggctcaagtgatcctcctgcctcagcctctcaagtagcaggtactataggcatgcgccactgcagccggcttttagacaatagaatttattgaatacctactgtatgtcagatgttggaaatcatatcagtgtacaaagcaggtagaattctctgcatagagtttatattttaatgttaggtaactcaactcttaaaaaaaatcagttaattataatgtgtttggcaagttccatggtaaaaataaagtttgataaagaggaattgcctggccaggcacagtggcttatgcctgtaatctcagcactttgggaggccgaggtaggtagatcacttgaggtcaggagttcgagaccagactggccaacatggtgaaacccgttctctgctaaaaatacaaaaattagccgggctcagtggcatgcacctctaatcccagctacttaggaggccaaggcaggagaattgcttgaacctgggaggcggaggttacagtgagccgagattgcaccactgcactccagcgtggttaacagagcaagactccgtctccaaaaaaaaaaaaaaaaaaaaaaaaaggaattggaagtacagacaggtgtttagagtccatatgaacagaaagcagtatttgagcacagattttaaagaggtgagtgagtgagccacttgattacctgagagaagagcaccccagacagtgaagaagccagtgtaaaggctctgggtgagagtgtgctgagcatgtttgaagagtgttgtggagaccaacagagtgagcagaggggacagtcagaaggtgagaagattagagatgtgaggacaagaaggacggctcagtatatctcacacaaccataaggtgatgtgtcagtagtttgtgcttaatagcaatggaatgggaggccattgaatgttcctgaaaagaagaacaccatgatcttatttatattttaagaggaacactctcctatgatataagtagatgattaggtgcaagagttatgacaggtagatcagtgagaaacaatggtccaggtgagaggtaattgtggctttgaaaaggtatgtcttttgtggccgggctcggtggctcatgcctgtaatcccagcactttgggaggccaaggcgggtggatcacctgaggtcaggagatcaagaccatcctggccaacatggtgaaacctcgtctttactaaaaatacaaaaattagctgggcgtggtggcaggcacctgtaatcccagctatttgggaggcagaggcagaggattgcttgaacccaggaggcagaggttgcagtgagccaagatcgagccactgcactccagcctggtgacagagtgagactccatctcaaaaaataaataaatacatgaaaagatatgtcttttgtatgttcttgataatttttgttttgtagtgtgttttgggtctatgttgctgggagaaacactttctgatgtttgtatgtaactgattttcagatacagttgaacaggtaatttgatttgggggcttggagtttgcaaagaagtagtccatatacttggaggaattgatcagatcagcattaacaagaatttccatttctgaggatgttaaaaaatgtctgaaaaaggtttccatagtctcttaaatttgggaagtgctccatttcacaaaatatgaaaggtttcttgataatagtacacattgtttcccaaattatgtgattataataccttttaaaaacaacacagaagatcttggaaggttttccttgtgacttaccacttgtaaacactgagaaatggtgatatgtttcaatttcatattttctcattgactcgtatcatggtaaaagaaaatcagttgaaaaattacccttgcttttttaaaatttacgtgataaaatagcccatctgaatttactgaatttgtctttatttttattgaatatgaaaaaagattgtttagtgtgttagatgttaaatgctaagacaattttagaatttaaggaattgaatatacagtattttcatgactagtccctcacgttcctttacatgccaggatctcacatcctttgcagaaggaaaggtacattcctagggataaaataaatgcatgttacttggacaacatttttgctttctgtttgctaaataaaaatcctttttaaaaatttagtattgccaaactttgccatattaaaaatgttttagattactatattatcctgaaactgcatgtacacacacaccactaaaataagttttatggtatttcatatgcctgtacgggagaaaaaataggaaaagaatacaatcatcataagttcttattattacattatgctgagatttctaataacgctgcccttttctgggtattttgtattaaacctaaaatttgtgatgttttagactgtttcactaacatgttttgataacgtctcagtacccttgggaaagcattataaagtagtgggcaatgatgaaacctactctggatgtttttaggcaaattttttaacttctctgattctagtgttctcttttataaaataggtgaaccaggatgagcccataggatagttgtgctgatgaggtgcaaggatgcatgccaggcacccagcactggctcttcccagacatggagtgctcagtaatcgtgagctattagaatacaggtgcccaaccagtgcttgagcaattgtgttctgtgtccaacagaactcaacagaatcccacgtttgtctttatatgtgaattcagttccttttgagttagtaagaaattttgcctgtgttggggtaattgaactttcaggaggagggaattgtctgccacaattattctctgaacttaatgtttccatgtctttttcttcattttggaagttgtggaaaaattataatgaaagagtatataaacgttttcctctgtattatagcgtatctgacagtttcctttattaaaaagtatgatacattagggagagacttaatgaatttaaaattaaagtttgaaaagtgttattgactataagtgatcttcagctgtgcagttttcaacttgaggttgtcagaatgtaatattacacattatattacacacatctacagaatccaaattgtgatgttcctggagtattggaacaatacctatgactttttgtttctattgatttttaactcttctaataaccacttctttaagaaaagtcatacatcatcactttggtgtatcagaaacaaattccttatgcaataaaagcatacttctttctcattcacctactgggatctagaaaccctgttaatgcaagaaaaaatcccaaacctcaataaaataacactctgtttgtctgaagagtggaaacacaacacatttcctctcaactggtggtcccagatcgaccatcacagtgtatggatgtgtttggaggtgtgggaataggactgctctgaggctctagaaggccagcaggttgggcagactgaatggagggaggggactggcattcagtaactactggagcgtgggaagagtgaggtagactgtccatctggtgaaggtggctgcttccttgaggtttgttactttctgtaatgttaattccctcaacttttaaaatttgatttttagacaagttatacattcaaatgatttaaaattggaaaataataaaaaggtaaacagtgaagtctctccctttcccctgccttcatgcccccagtttgcatctccagaaacctcagaggtttctcgtgtaactttccagatgtgttttatgcatgtacaaggaaatgtgtgtttatatatatatagtgtgtgtgtgtgtgtgtgtgtgtatatatattttgttccttttgtcttactactttttactgtccttcatttttttatggctgcaaatattcctttgtatggaaatataagcaatttaatttacctgttctttcccctgttgatagacctttgggtttctttcaatcttttttttttttttttttttttttttttttgagacagagtctcactctgtcacccaggctggagtgcagtggcatgatcttcgctcactgcaagctccgcctcctgggttcacgccatcctcctgcctcagcctcccgagtagctgggactacaggcacccgccaccacgcccggctaatttttttgtatttttagtagagacggggtttcaccatgttagtcaggatggtctcgatctcctgacctcgtgatctgcccgcctcggcctcccaaagtgctgggattacaggcgtgagccaccactcccggcgttctttcaatcttttactgtgaatagtacaatgaatcacctggtatatttataatgttgtaggtaagtgggcctgcaaaggtgaattccatgctaaatccaaagacataatgcatttgaaactgtttttggcaggtaggatacagttttttgtttttttcttcatttatttttattatacatatctgaggtatacaacatgctttgtatacatagtgaaatgattactatggtcaaacaaatgtctgtatccttcaccttccatagttactctctgtgtatgtacacctaaaatctctttcagcaaattttcagtacacaatattattaactatggttctcatgctgtgtattaatttgatctctagaattattcatcttacctaactgcagatttgtaccctccgacctacttctgcccatcccacccatcccctacctccagactcttgataaccaccattctactctctatacattcagcttctcaccccccggcctcccattctgcttcttaagtgagatcatacagtatttttctgcgtctggcttactttatttagcatactttcctcccggttcatccatgttgtcacaaatggcagtatctcctttcttaaagctaactattccattgtataaagtcctcattgtcatcagtaagttcttagaaactgtggttaagaggggaaaaaaagtatgacaaaactgattttttttttcattttgcattatgccaaaattagattgaaggaaacagtgttacttgaggacctgctgtatgttcatttagcttaacgtctcagttcccaagaacctattgatgacattaagggaggacttaatatatgtataaacaaatgtcacaatttctttatccattcatctgtccttgaatgggtaagtaaattgtccattaggacacttagtttgtttccatgtcttggctattgggagtaatgccgccatgaacgtgggaatccagatgtctctctcagatgctgattttattacctttgaatatatgcccaacagaggcattgttggatcttatggtagttgtattttttttaaggaaactctatactgttttcaataatggctatactaatttacattcctatcaaccatgtacaaaggtttcattttctacacatcctcaccaacacttatgtctttgcctgtttgttaatagtcattctaagagacaggagatgatatctattgtggttttaattttcattttcctcatgattatgatattgagcatcttttcatataccatttgaccatttgtgtgactttggaaaaatggctattcaggtccttgcctattttaaaatccagttatttggggatttttttttgctactgagttgtgtgagttccttatatgttttggattttaaccccttatcagatgtgtggtttgccaatattttcccctaatccctgtgctacctttttaccccatgttttttttattgctatgcagaagcttatttgcttgatgtagtcccacttgcttatttttgcttttgctgcctgagcttttggtgtgatatccaaaaaatcattgtcaaggaggatattaaggagtttttctcctatatttccttctaggagttttatggtttcaggtgttaggtatttaatctatttgagttgctttttatgtatgatgtgtaagataggcatcaggtccagtttcattcttttgcatatagatatctagttttcttaccactacttattgaagacaccatcttttccctattgtatcttattggacttgtcaaaaatcagctcataatatatgtttgggtttatttttgggctctgtattcagttccattgatccatgtgtctgcttttatgccagtaccatacgttttgataactatcactttgtaatataagttgaaatcaggtagtgtgataccttctactttgtttttctttctcaagattcttttggctattcagggtcttttatgatttaatacaaattttagaattgtgttttctatttttgtaaaaaatgcctttggaaatttgatagggattgcattgaatctgtagatcactttggatagtatggacattttaacaatattcttccaatccacaaacttggggatatcgttatatttatttgtgtctgtaggttttttctgttttatgagacagagtcacgctctgttgcccaggcagaagtgcagtggtgtgatctcagctcactgcaacttccaccgcctcctgggttcaagcaattctgctgcctcagccccccaagtagctgggattacaggtgcctgccaccatgcccgactggccaatttttgtatttttagtagagacagggtttcaccatgttggccaggctggtcttgaactcctgacttcaggtgatctacctgccttggcatcccaaagtgctgggattacaggcgtgagccaccatgcccggctgtgtgtcttcagtttactttgtcagtattttatagtgtttagtatataaagctttcacttccttcattaaatttgtttctcggtgttttattctttttgatgttattttaagtggaaatgttttcttgattttttttcagatcattatttgtataaagaaatgcatctgatttttgtatattgattttgtatcctgctacttgactgaattcatttattctagtaactgtggaatttttaggggtttctacatacaggatcatgtcatctgcacacagggataattttacccccttttttatgctgatgccttttatttccttttcttatgtgattgctctggctaggactatggtgaatataagtgttaagagtaggcatccttgccttgtagcagatattgaagaaaagctttcagtctttccctgttgtaggtttgtttttgaataggcaatacctgtgcatgatacaagaaatacaaaggtcttaaaaagagtgaacaatgttaagttagcctaccttttggccatcccttccttggaaagaaccagtgttttcttataactttccagagattagtcatctagatacaagtatgtatatatgggagaatttctcatatttgggtgatatggtctttttctcttttcttttcttttcttccggtctgtctttctttctgtcctcgtctcgtctcttctcttctcttttcttcatttcttttgatggagtcttgctttgtcatccaggctggagtgtagtggcgcaatctcggctcactgcaagctctgcctcccaggttcacgccattctcttgcctcagcctctggagtagctgggactacaggcacccaccaccacgcccagctaattttttgtatttttgtgtttttagttcctctcctctccaggagaggaacaggggccacagggagctgatcatgaaacacactgagggtgtttcatcagggaagtgacaggagcatagtcacattcaggaaagatcactgcctctgggaagacagagggtcagggcagagcctggaggccaggagagtgccaccttcaaacagggtggaggaggcacaattctggacagggatgtccatggccagaggagtgatccagctcctagaagatgaggagagaccgaaggtgaggatggctcttcagtttcaggtttaggcacctggacagatggtcttgccttctccagcggcagaaagcactgaaggggaaagaggttgggggaagggactgtgtaggctgagcagcctaagtctgagaagctgggccacttgcaggtgttggtccagggtgcaagtgcatttggtgaagggggagactaggaagggaggagaaagtctagtctgttactagacctcaccatgctgcaggtgtctgggccagcaggtcgcagccggagctgtgcagctggctgctgtcacatccctttctctcccagctgccttcagctgagcttaacgccagcagaggccgaaacacttcacaaatgcaacttgtcagctgggaggtgcactcagagctcaggaacactgttttccctctttattgttttccatcatttttttttttcagtctgggttttgggccccgtcagttccttttctgttcaacactgagctatgtatccacccctctcaaggttgaaaaagagaaagactgtaaaagtgccctgcaaagaagaggcttccaactctctgggggtggggggggtggggggctctcttcctcctcttgtcttctgggttcattccaaattattccccaaaggaaaaatcactgaaggactgggggcggtggtggggaaaaggacagtctcccaagaggtcaggtgaagccccagcctcatggtgttgagggaggggctgggggaagcgggagcctgttcctaggagacactgtctactggacacctcatcctagaaggcttccctgagttctgacactgttctaggagtaggaatcattatcccacgctgtggagaaggaaaccaaggccgggtaaagtaatgtagggcccttaaagttgcagagccaggaataaagtccggattggggctcaggtctgtgggcaatccaaggccgtcccctttacacttcaaatgctctttccccctccggaagccctcgcgtcctcatccctaccccacctcttgttccccaagcgtggctagggctagggctccagggctacgccaagcacccttcggtcttcccgggaagaattttccccggcccggggctagggtctggcgctggggcgctcctgggacctgcgggatcaccactacactctggcgcgccgagcgcggtgagctaggacgccaaggcacaggtggggctggagtccagcgcggaggcgcggggggcgggacgcggggccggggagcggccagggaccgcggcagcgccgcagtgccagcccggcgctggcgactgcctgccccagcccctcagtggcggcttgctctcttctctcgctccgaaccagacacagccgctgtcgctgccatgtggcgcgccgcagactcccgagaacagccctggctgtcagcgggcaccagccgcttcctgtgcccatcgcgtagactggaggggcgcaccacggccaccgagccagaggcgcttcaggaagcaagagaagtccccgcgcgctccgggacccggcgcagctcatggtgagcgccctctggggctcgagggtcccttggctgagggggcgcatcctcggggtgcccgatggggctgcctgggggtcgcagggctgtagttgggatcgcgcacaaaccgactctgcggcccagcccgaaatgctgccgccaaggagcaacggcaccgcgtacccggggcagttagcgctgtaccagcagctggcgcaggggaatgccgtggggggctcggcgggggcaccgccactggggcccgtgcaggtggtcaccgcctgcctgctggccctactcatcatctggaccttgctgggcaacgtgctggtgtccgcagccatcgtgcggagccgccacctgcgcgccaagatgaccaacgtcttcatcgtgtctctacctgtgtcagacctcttcgtggcgctgctggtcatgtcctggaaggcagtcgccgaggtggccggttactggccctttgaagcgttctgcgacgtctgggtggccttcgacatcatgtgctccaccgcctccatcctgaacctgtgcgtcagcaggtcatcagcgtggcccgctactgggccatctccaggcccttccgctacgagcgcaagatgacccagcgcatggccttggtcatggtccgcccggcctggaccttgtccagcctcatctccttcattccggtccagctcaactggcacagggaccaggcggtctcttgaggtgggctggacctgccaaacaacctggccaactggacgccctgggaggaggccgtttgggagcccgacgtgagggcagagaactgtgactccagcctgaatcgaacctacgccatctcttcctcgctcatcagcttctacatccccatggccatcatgatcgtgacctacacgcgcatctaccgcatcgcccaggtgcagatccgcaggatttcctccctggagagggccgcagagcacgtgcagagctgccggagcagcgcaggctgcgcgcccgacaccagcctgcggttttccatcaagaaggagaccgaggttctcaagaccctgtcggtgatcatgggggtcttcgtgtgttgctggctgcccttcttcatccttaactgcatggtccctttctgcagtggacaccccaaaggccctccggccggcttcccctgcgtcagtgagaccacattcgacgtcttcatctggttctgctgggccaactcctcactcaacccagtcactatgccttcaacgccgacttccggaaggtgtttgcccagctgctggggtgcagccacgtctgctcccgcacgccggtggagacgatgaacatcagcaatgagctcatctcctacaaccaagacacggtcttccacaaggaaatcgcagctgcctacatccacatgatgcccaacgccgttccccccggggaccgggaggtggacaacgatgaggagaaggagagtcctttcgatcgcatgtcccagatctatcagacatccccagatggtgaccctgttgcagagtctgtctgagagctggactgcgagggggagatttctttagacaaaataacacctttcaccccaaatggattccattaaactgcattaagaaaccccctcatggatctgcataaccacacagacattgacaagcatgcacacacaagcaaatacatggctttccagtactgctccctttatcatgtgtttctgtgtaatagctggtgtgcttagaaacctcaccccattgattgatagttcaaagaattggcagaagcagttgcaataaactcagtcaaatgtacccagcctaccagagatggaacaatgatcctgtgagagaagagagtatggtgctggctccttaaaaaaaaaaaaaaaaaaaagatacttggtccttaaaaaatatgctctcccctccctttttaaacaaatggctttttcagtcacttgtttgtgtttgaattgatttttaaacagcaggttttgtgtgtgtgcagtgatgtggtgggagcacacctttcctgggtctggattcccgtggctttgtgcttgtgtcatttcttctctctgtgctggtgggggtctctttaccatagcttaagaagtctccctgatttattctggtatctaataaacacagattatttgtattatgtggtgactatctttgctttgctacactgggtttcaggattgcttctgaagaaacgatgagtgcatccttaaaatgcaaagaagacatttgctgggtctggaagtacatgcttattctctttacagtttggccttaaagatacaccagggcaaaggaccttgaggagcttctgttttctcaggtttctttttattacttatacacatgttgggtctgtgctgaaacctggcttcaatggcatggcattagatcttctcaagcccagattttttttttcatttggaatcttttttgaagtaacatgagacaactctccttattcctagacagatgcgatcagttcattgaaaagttcatgtagaataatatcttgaatctttctccatctgaaatctgtagcatgttttagaatcacatggcttttgagaaatcctgttttctgaagggctttgaaatgtgtgaatcaagatgctttaaaaaagaaatctatttttaaataggcattttccttagtggacaatagcaaataaagaaatgctttttaactaaaatgtagaagccagagatgaaatgtgaatgaacttgaaattggaaaatctgtaggtcgaggtgctcaatagaaaagcccagctgactccaatcattttgtttttcctctctgcagtgtgcacagtcaaggggagtgttttattccagacccacaccagttgagagcatagtattaccatcagatctaaatatgagcactattaatggaagcaaatgaaatgtgaatatgcaatttcttgcaagtccctgctttgaagcagttttatcaaggacagttcaatcaattttgatctctctaaggctaattttattgtcagtcttctgtgcagccaactgcaaaatgtgcagctcctggcacatcgtacttaataaatatttgttgaatgaatgactattctggaatagtgagattgaaagcaaatcctattcggtacatcaatttttatatataatttagtcaaaatgatactggaatctgaggcccgtgttcagtttctgacctcctgtgaatggatagctaagtgaaccattaggcaacattaggggcagtgaaaagcacacagctctacgattcaggagatggtcgcatgaccttgagtgagtcaattaacctttctgggcctcattttctgtctgtgtctgtaaatggaaagacttcagctggatcactgtttacccaattgtgctttgtgatgcagatgttaatggatggggtctctggtgaaataagttcagcaaacccaggttcaacacctgttttctcgataggacttcttagagcttctcctgtgcatgatgcatctccagtgcgagaagattctgtatcatttcccaatgccattcactttgtgaaccttgtttggtggaattcctgttactgtttcactggagtccacagtcactacttgagaaactcaaatctaactgatctggaagtctttacaatattctgttctaaagcatgggttgctataagcaaaatcttttgtgaaaaacactgttctaggctccagtttaaataagttctgtgttatggaaaatgggttatgtgaggactttggaatttccttctgtaaaatatcactcaccattcattataattacgtactatgctctaggcattgttctagatgctgggaatatagttgtcaatcaaattctctgctctcttggaacatttatgtgagctgtgggagagataagccaataaagagatctgtactatactgcactgcattgcactgtgctgtactgaccaggatagataatgccaggcaggggtaattgctatgttgcaaaaagcccagggtgagtagggtggtgaagctgctgttttatttatggtggtcaggggaggactttccaaagagccacatgaagagagaccttgatgaagtaaggattagagggctgctaatgtctgggaaggagagcaatccaggcagagggagtggcaagtgcaaaggcttggaaatgggattgttcttggcaccctcagaggagtgtggctggagggctataaaagaggagtgtgataggattaatgttaattgctgtagcagcaattgcagcaggcatgatggagacccagcctgtgctgggtacaatacatgtattaattcatttcactctcattgccctgtgaggtaagcacttttattaccccattttacagataaggaaatgaaggcattggcaggctaaataaccagcctgtggtcacataactcctgagtggcagagctcaacttgaacccaggtagcctggctgtggagtctttaatcctaactgctctttgatggtgagagaggatgccaggacatcttcagtcagcaaatgcactagtgcacagatcaggacattcagttttttgttcatttgttactgaaatggttaattgattcatccccacagctatacaacagcagatcttcactgtgtacctcctctgtgcacagctttgtgtttggagggaaggcaccctagggttatgggcaaagtagctcttacatgatggaccaattgctttcctggattcttatttattcctcacattaacctcacatgttattatttttccattttacaggtgaggacatgggggcacagaggaccttgaggacaaggttgtttgtccaaggtcatgtgaaaagtaagtagtggaaccacggttcaccctaggtcagtggttcttaaatgagggaactttgcaccctgcacccccacagatatttggcaatgtctggagacatttttggttgtcacaactgggtgtcaggtgctcctgccgtcttctgggtagaggccaaagatgttgctaaacaacttatggtgcacagagaattatccggccccaaatacccatcttgcagcacttgagaggccttggccaggcgggcagactccaggtcccagctccccgtccacaaggccacctgcctgggattggaggctccagtgccctaagtttgaagtttggctccaccatttattagtcttctgaatttgggcacctttctgagctccagcttctttatctgagcaatgggcacatgaaccacacagagcgtgaattacacaaaacacatgccccagatcttccttgttctgatacatgctgaatcttcttttataattaggcatccatacaccatattcattggttagaaatgagtcattacgtccaaatcatattcaaggggaggtgattagactttacctcttcatgggaggagtgccaaagaatttgcagaagagatgttttacattttatgctttatttttaaacacttgttctcacatagtttcagacttacagaaaccttgcaacacggtacaaagaatttctaaatattgtttacccagatcccccaaacatcagggtttcactgtatcacttatctctgttcttccctttttcttctgagtcatctaaggtgtgatgcccatttactcttgaatattttgttgcatatttcctaaaaacagggaattctctcgtctcatctacagactttattcagacttcacaataatgtcctttataacaaaacaatccaagaccatgtgttgcatttagctgtcccctgtaatttgaaagtttctgctgctttgtctttcttgacacagacctttgtgaagattacctggccagttacttggtataattgtccttcaacttcggttttttggtgcttttccatgatcagattctgttatgcatgttgggcaggaatatcactgatgccatgctgagctcctgtagctcaaggcatgaggggcaggtgctattaattagtcccattactagcaatgttaactttgttcatggggttacggtgctgtccaccgttttactctttataattaatatgtatttcctttggagaaatactttgagactatgaagatatcctattatttctcaaacttgcatccattggttttagcatttattagtagcccttccctgaatcagttattactgtggttgtcaaatcatgttttttaaaaaaattctgtaatctttctaaatgtattgttggttttctactgtaaggaagaacacttgtttatattattggcatcggcatagaatcttggttttctagttttctgtttgtttttgagacagggtctcactctgttgtctaggctggagagcagtggcatgatcacagatcactgcaaccttgactccagggctgaagtgatcctcccacctcagcctcccaagtagctgggaccacaggcatatgccaccatgcccaggtaattttttttttttttttttttttgtagagacggggcctccctatgttgtccaggctggtctcaagctcctgggctcaaacagacttcccacctcagcctcccaaagtgctgagatttacaggcttgagtcaccatgcccagcccgggtttctagtttttataataggttataatcttttacttgacgctgttaatggatactatttttacattccaggtatgggacctggggacacatgtgtcccatttctatgatattaacacaatgctcattctaggggcaacactcagaacactgttttctattgtcttctaagactgtccctgacctcaaatctctcagtgaactgagggtatccatacttatcatgatatttaggttgccctagatttggtgagtgggagccctttaagttggttcttgtgtccttttgacatgctgtcattattctttgagtagtttgttacttttcaacatgagatatgtcagactcatcttgtgtattccctgtccaagccttggaatcatccatttttccaaggagaccagggttccttctagcagaaaatgatatggagaaatcaagatgtgggcactagggtgtttattgttactggggtgatattgtttctatatcctcttaaaagacagagttgggaaatggatacatgtatatacatgcacacatattcatatgtgcatatacacatatccttgagcatctctatctatttctatgcctacctatgtacatatatcaaatcccatgcactcattttgatatctagcagacatattttaaaaaccatcacctctggttcaaatcttgattctctaatgttctagttcatgagaactggaagtcaaagagattaagttaccttcctaggtttaaaaaatgttaaaaagggaataattagttgcttaccttgtagtttattgtcagagttatgtgctatgatgcatgtggaatgtgtaagggtgttacacaatgagaatttaaaaatggtcttcttgtgactgtgcccttaagagctgagagtacagggcagaaccttcctgtttctatgtagtggttccatgctccattttacagacagtgtgagaagctactagggatcaagaattcaagagtcaatatgcaggagagggatagagtagctgaagagcaaactagacttgcctacacctagaataggaagaaatagcacaagatgtcaagcttgataggaggaagttgttgatatgaggggagagttaatcagagaatgttgagcccatgtggaaccccctggacctctaggccaatttgggggaagggcttaaagggaatatgagtacccctactcacaagagcaggcagagccatcagacttttgctttgacactgttaatgaagtaccattttgatattccaggtatgagaccaggggatacatgtctcccatttgtaggatattaataatacaatgccagttccagggaaaacactcagaactttgatctgattctcttctaagatcattgctgtcctaaaaactcttagtgaactatgagtaccagcactccaccaacactgacagaataaaggtgacaaccagcatttgttgactatctattgggcaaggtgctttgtatacatcttctcatggaatcactgcaatattcttgtgacataggcaccattgtcctcatttggaaaaggaggctgagagaggctcaatagcaagccaggttatacttctagtaagggatagaagtgggatttgaagagcatctactcctggagagccccccttttgggctttacacaactctttggagggactcaggaagaggagagctccttcatgtatattgcccatgggtcctctccaggtgaagtattttgaggttctgaaaccattatcagacttggctgtaaattccctctccatcttggaccttttcctgtgctcttccaatggccctttccaatgggtaattagacctcagttgtctacatgagtgagatctgctcagcatggagagggctctatttttctacacccttgataatttgtaggtttgggaaagcatgcccagtgtggcttgtcagggctaacacatatgccttcattcatatgtcaacttggcttcatgggtaggggctgcctggagtcctgggatgagaaagactacacaattgcattccaaccaatgacattgaggggactggctaataaatgatttctgttaggagcttgggaggtgggggatgtgtgaatgttctaagtacttgccattctgtgtctctccacagcccctaaacctgtctttcctagaaccacttgaaagttaaaatattgatgtctggggcccactccaaattagttaaatctgaatttctaaggaataggacctaagcttcacttttaaaaaaaaattgaatgtgttagaatgtatatagccacaattgaaaaacaccattggtctacactatcattaggcatgtttgaaaattatctgccttgaccctgccctgatcttgcctttgctacaatattaaatgggctcttattaacaatgaatatatctaattattctctagatcttttattagcttgaattattcttagatattctgccacataaaagtatttgaatgtgtagtctttgtggttgatggtctaatcagctaaactcaaacctcactgcagctgtgactagaaagtcctcattgatggagaatcctagaggtcctttcagagaagaaaaaataattcagtgggccaagctgtaatattttgcctctgattctcagattccttgttggcaaaatgggaatgcaaaataaatagagtctatagtcagtacctaataagtatttgttgaatgaataaattagtggaatacaaaattaaaatacttgtctcatcaaacatctagagaaaaaggagacagatatagagctaacccatgcctgttataccatttaatgctaggcgtatggaagcagatactgtgtctctctagtttcacaggctctcagagagagaggaactgtactctaggagctgcatgtgactagtcattctcaagaagtccccaccccaatacctgatttgatgagattctgaactttagttgatgctgaagggggaggagatttttagggatcttggcaggacacaagtgtattttgcatggggtggaggatgtgaatcactgggggctggaggacaggcttcccagcagcccctaagatggcctccagtgatccatgtctcctggtattcatgcccttgtataatcctctccactcccttatatcttggctgaacctaatgtcttgttcctaacaaacacaatatggtgaaactgatgaacagcacctctgagaagttacaaaaagaaaatgacttccatcctgctcaccctctcttgctctcttgctttcttgttctgatggaagccagcagccatgttgtgggtgttctatgaagaggcccagtagcaagaaaccagaggctgggggagtgtctgaccaagagtcagccaaaacctgaacctgctaataatcacatgagtgagcttggaaaggaagcatccctcagttgagccttcagatgagaccatagccttatattactccttgattgcggcctttgggagactgtgagccagaagacccagcgaagctttgcctgggctcctgactcatagacactatcagaaaaacacttgctgttttaagctgctaagttctgggttaatttgttatttagcaatagataactaatatagaagaaaagggagagaacatttattgaatcctttgctatgccccaggtactttgtaaatctttttccatttcatccttaagtcaacctggatgaaaatattcaggttcagagatgctgggtgagtgccaggggcaggatatgaatcactactgtttgatttgaaagcctgtgctcatttctctattccaggatgcaaaccaggagacgttttctattctatgtttcttttttcttttcttttcttttctttttttgtggcagggggacagggtcctgctctgtcatccaggctagagtgaagtggagcaatcatggttcactgcagcctgaaactcttgggctctggtgatcctcctgctacagcctaccaagtagctgggattataggcatgcgccaccacacctggatagttttttttttttttttaatttttattagagactaggtcgcactacgtcacccaggttggtctcaaactcctgagctcaagggcttcttctgcctcagcccctacaaagtgctaggattacaggtaggagccattgtgtccggccacattttctctgttcgtaaagtcagcagtagaatagctaacattgttgctaaacagtttgtataaaatgagtaattattagtgcccctgcatgcagccacctgctgttgctgaccttctgtgcctctgcagccaaacatacatcaggtacttatgtatacacactccacaggcacacagatgcctccacaatacacatgtgcccaagatgcaattgcaagcacacaagtgcacaaataagtacacacatgtgtcttcacaaagaactatctccaccttcattttctcccatccaagtactaatcaggtctgaccctttttagcttccaagatcagatgagattgggcatgttcagggtatatggctgtagcctacatcctcttttttttttttttttttttttttgagacggaatttcgctcttgttgcccaggctggaatgcaatggtgctatctcggctcacagcaacctctgcctcccgggttcaagccattctcctgcctcagcctccggagtagctgggattacaggcatgcgctaccacgcctggctaattttgtatttttagtagagatggggtttctccatgttggtcatttttaaatgaaagaccctttgagacagttcatacctaaatatgtaaatagtgcacaagattttgcagcctgaacagaaatggccactatagttttttctctttagcaattttctgtgtgctgtaaacaaatttgaaatctggctagagactttggaaatcatgttgaccactccccatattgtgcagatgcagaaattgaggccctgagggacttgcccaagtaccccagcaaagtggtgtgaactgaagtccaggtctcccaactcccagttgactgtccttgctgtggcactgtgcaccgtcggtggggagaacactcctggtccttaggaatccatttctaaaggacatcaggagcacaaacaagttcatgccctattgttctttccacgtaaaagaagttgatgacatttatgcttttctcacaatacaccattaagatagaacattgttgaattatttgtggattaaatacagatgtgcagggattttagggccctgattgattttctgttgaaagaagcgaaaggaatgttaatttacaactggcaaatgttagctcttaggaggaggcaaaacagcatttcgaaggcctgttttttgtttggttttggtatttcatgaaagagatttttctgtgcaaagtggcaggaagccattttcaacaagagctaaagggaatgaagatttaaaaaatggaccaaaaacaaactcaaaggtgccaggcctttgttactgcaagcccctcttgcaggatgagaggctgctaaaacaaaatcaataatttaagcaactttctgtccctctctcccctgctattctggtaaaatgatttgacatttcagacaacaaggaatgaacatcagaccaggaagaaaagggcttggttatgagtcccagttgtgtgattttaagtacatgattaaacgtttattaatttggttctctcatctctaataatgaaaccatcactcttacatcttgagtgtaaaaaatgctcatttactagaactcgccctgtatcagatgccacattaggatttgtgcggagtgatctcattaattcctttttttttttttttttgagatggaatttcactcttgtcacccaggctggagtgcagtggtgcaatcttggctcactgcaacctctctctgccacccggttttggtttcaagcgattctcctgcctcagcctcccaagtagctgggattacaggcgcccaccaccatgcccggctaattttttgtattattagtagagacggggtttcaccatgttggtcaggctggtctcgaactcctgacttcaggtgatccacccacctcggcctcaagtgctaggattgcaggtgggagccaccatgcccagcctcgttaattctttatagcagccttgtgaggaggtctgttcattctcactgtacagctgaaggtgctgaggctcagaaaactcaagcttgtcgctcagggtcacacagctaagaaatgacaaggtggagatttaaacctatgcttgtctggctaggcactgtcttatatagtaagagtgtggggatgacagattgcaaaacaaagcaaaataaaactcacaagctctgaagatgtagtgactgcctactctgcccctgtgctagcgacccagagttaaagatgggttctcatcatggtctctgcttctatggatccctcagtggcttgagaggaaagcaaacctggtggtggcaacgagggcatctaatattttggattccattttggactcatgtttaaagtgcatatgggctatacaggtgggtgtatgagccgaggacaagagcagaggtctgggtttgggaccaacatcaccaaagatgatagccaacactgagtgactgctgaatttgtgctgggcactgtgccaaagagttctcaggcattaacccattctttttttttttttttttttttttttttttgcggagacaaagtctcactctgtcacccaggctggagtgcagtggtgtgatcttggctcactgcaacctccgtctcccaggttcaagcaattctcctgcctcagcctcccaagtagctgggcctacaggcatgcaccaccacactcagctagtatttttgtattttagtatagacggggtttcaccgtgttggccagggtgtcttgatctcttgacctcatgatccgcctgcttcggcctcctaaagtgctgggattacaggcatgagccactgtgcctggctgcattaacccattctatcctcagactgatgctgtgaggctgctgtccttaccctgttgtacagagcagtgagaaaacttgcttgtaggtgaaagttaaaacttcaaggaggatttttcttgaaagccatcccaaggtttttctatttggtgattcatgatcaatcttatgccccaagtccccacattccctctattttgagtcactctgtctcataagagcccctggtgcctttgttttgcttcatttgaattctggattcagcatgcatcagaaatgttctccctgagagctggaaagcatttttgtgatggctgggctgcagggccattaagaaaatacctttgcacaccaacaaaaaagactaaagccttaattgctgatccaaaaggcaacaggaaaggatgcaccactgcatatatggtgagggatgcattgccttggtcagggcacaggtcctctgtccctgagtcctgtttccttgtgtgggtagagggcattttcacactctctgtccccaaaagacctcagggggaacaaaagagcagcatgagcagggggccatggtcatgggcattgactgggtgcttgctgcatgcaaaggctctgtgttaagcaccttgggaacactaactcatttactgtcccaacaaatccaggatgtaggtacaagtaatagtcccactttacaggtgacaaaaatgaggaatagagaggtttggtgatttgctcaagatcacacagtatgtgtggcacagctgagattctgacccacaggtgagactcttgagcttattcttctcactgaaccccctgcctctcatggttatgtggctcatgctcccatagccttaagtcctgaggctaaggaagggtcctcagataaaagacgtcaatttctgtgtcttttttgagcaggcttcatgaacatcaacactcatttgaggttactgagagcatttgcctggccttaacattgtcatcccaaagctgtttgccaattcattcccatcttcatagccctgtctttctccagcaggcttggtctgtggttctaatgaacacaggaggcttggttcattcggatgcaggaagtgaggaggaataacatgaaggggattgaccagatgcctcaattctaatcagctgaatggagatacttatgatacctccttatgcagtgctgtaacgattagatgggattctttatataaaggacttagaacaatacctggcatgttgttagtactcaattaactttatacaatatattagtcaggctttgttgtgatgatgccacataaaaagtaatccccaaatctcaatgctaacaacaacaaacatttacttctcatttccataggtcagctgtggttctacagggctcttctgggctggctagattcagatgggcctggatctgggtggtgaattgggttcctatttgcttcacttggctctcagaagaggatccaggggagtagcagcagctatctgaagcatgttcatctcatgctggaggacaggatcaccagaggccatgcaggaatatttaacgcctctgcttggatgtggcattcactgagtcacccacattccattagctgaagcaagtcacatggctaagcccaatgtcagtggggtggggaggtacaccacttccattgaaaggagggaaaacagatgtttgctgaacaataatacaatactatgatctatcacaatactatgatctaccattatactatgatctaccattaacatttcttgaatgcctaatagctctcaggaagtgttccaagaatcatggattctagagatgaatcacatagcagctctgctgtctgctctcaagggtgccctcactacagagtgtggtcactgcaatgacaaaggtggccccaggacaacttaacctctcctgaactattttaattctcacaatttccttgtaaccccagtatcactatccctattttatagacaaataaactgggactcagagaggttcagtaattttcttttgtccccatggctagaaaatggctaagcctagtaccaaatccttgtgtgattgttccagggttctgttctttgcatgacaactctggactcaggtatgtaggcagagacattagaattgagacagagactgaccaaaactctcatatcttggcaggagcccaagtctgcatatgtatgaacctcatccatatatatgcaagctgtggctgagacatctgtaacctagactttcatagctgggctactaacttcattcatctgaaggaagattcaagttataaactgccaccaattcagtgaattatccataaacttgtttctatattgccctatgatgctcagttcaagcccaagtcaaatgctccctcctgaaaacttctctgattccctagccaccagtttctgcctgtgttgcctgtccacagcaccaaacacttaagacactttctccatgatcctacaattttttttttatttttctgagacagggtctcactctgtcaccccggctagagtgcagtggtgcacatgatcctacaaccttgatgtatatattttaggcaatcactgctcacagaaagcccatattctcctattccacctccacagtccccagagttccagcccagtgcttggcattcagcaggggctagatgaaagtgtgtggaatgagtgaatgaacgacggatggatagaggctgctgggtccttaggaaagagagcagatgagatttattttttatttttgtccgtatctcctctttggtcctttggagggattttagtcaggatgggtctggtgcaaccaggtgatccaagggttataggcacagagggaagtaactggagctccctttgggtaccacagtaaacactggtggtggaatgccattgtcttatcttctgagaagtagcaggaggcttccatattcttgtgtttcgtcaactggctctaatcattaagctaaatactcagcttatgcaatgcacttagcccagctgatttagaagtggcaccttcccaatcagtctagagcatttgggtggtcactgtattccaacattcactacaattagggactgccagaaaagcctgattgtcttcactggttatttataaccaaatcatagtagcaatcattatgtaaaaagagctgtttctccacgcccccaacttctctgcctcgcccactcccaatgtcagtccttccattttatttaatgcttctggctgcagtgattagatgtaatgagagtgatagggctttgagttggaaagtgctagaggcaaaggagttttgttattctcatccttagagacacagaattcaagaggtaaaggggacttagagatttctagtccagcagtcccatgctatagatgggaaaacttgaggatcaaagttaggtagcttcatgaaaagggtataaatgtggaaatccaagactccagttctaactgaggcttaatcacagataacgtgtgtgatcttgagctacttgcttagtgtctctgggtctgagttttcctttctagaagatggggaaactaatacgtattctggagtgattagagataaggtgtagaagtagccaggtgtatggcagctggtacaatggatgccatagtaaaggagttggtgccagaatcactgcatcactgctctcttcccatcactccacattgccttcaactagctgagtgctcctgctgaagaaccgactcctatgttccctggctctcaacatgactcagtttgacttttcataagtgcaggtaagcaaggtaaaatgggagttctttttcctctctacagatggaaaataccagcaggagaccagccaagtagagctgggggaagtcttgagactcaccctatggtctccatgacctttgtcttagttcctttgagccgctaaaacaaaataccttagattgggtaatttataaacaatagaagtttatttatttatttattttttgcagtgtcagaggctgggaagtctaagatcaaggcatctgcagattcagtgtcttggtgagggcttgctctctgctttaagatggtaccttcttgctatgtcctcatgtggtggaaggggtcatttgttcatcttcatttcttttataaggtcattaatcccattcagaagggctctgtccaaatgccttaatcagctcctaaatgccccacctcttaaaactatcaccttgattaagtttccacatatgaaatttggagagacacagacattcagaccatggtagtccccatcctctgatgtggaccggcagcacactcacagtcttacataaatgactctgcaagtgcagctttctgagctccattccaattgtccctctccccacctccatagcagttttggtgaagccctatgtaatttcatgatctacaggtagatttgatagatggtgttatggtaccaggagtggggagcagccaaaacacaaaccctaaaatatgtggctctagggccagatggcagtcagcaagagaaccgttactgagggttggaaagatggtaatctatgttatgcagtggtgaaatatttggtaaagctgttgtaggaataacttgaagggcggatgatgtgctgaaggaacttgaagcttaaggtgaaaagatggggaaactgaacgttagtaacatcccttggtcactactgtaagaaagagatgagctcagaaaagaattggctaaattgtaagcaggtataaaaagaagtagagagggtccaggacttctggagtcccatttctcccaggaaggggcctgcctcagtatccatgccaagctcagttactggctgggagctgcttgtgggaatcacttccctctgagtgtgactcagtcatactctaaagtacgacatgactcttccttgcagagatctggacatatacagtgtccagtcacacggacagatgcagcttctgtggtcactctagatgatgctaacttccttatgctggcatgctatcctcataatgcaggctgcagttaactattttaaaagttaacatggtaagcagaagtgattcctctttggctcgaacatggactgtttggagggcactggagagaaccaaaagagtgagaagttttgagtgcttgtcatgtaagaaacaggaaagaaaatgcggcataattacctgtctctggggagaggagcaggattgcttttgttcctccaagtaggcagaaacagaaacactgggcagctggtacagagagacgggttttgagaggcagtactctcccagcagcactgtctagccagctgtctgcccgagtctgggggtgctagtgccttctgcaggattaccctataggaggcatttccagggtgctgatgtggactcatgccagaggtgacagtgtcagccatccatggtggaaacacaaaaataaggacacttagtgagcttggcccaagctattacattttcatctctgaggttatatttcccacacctttaccgttgaatgtccttttatcaaaatagtagtcattgtttaagtgatatctctatgttaaaccttacatttttttctttttaattttattgatttgtgaaatcctaaagtcttgaaactcctaagctagctgacttttcagatctgggatctcttttatctctaaatgattatgattcctgactttttttttgatataaacactcaactgccattaagagtgctcatgatagggaatagatgctgcatttgttcatgtttaaatactgaggctcaagtacctgtcagaaggagtttattatattttctaggctctctgaaattacatcagaaaaatgtgaattagaatataacccataaataatatctggccacatgcaaagtaattgaagatcaattgaaatagctattggattaagaaatagagactgaggtaaatttacagggtcagggaggatctaaggaggaagcattgacactggagcccagggacctgggattacagaacagattctaccagtgctaacttactgctccaaagaaaatatcaaatctgctcatccgcaggtactattcatcaagaaagggattacaagttcacaaatgtgttcaaaatgtacccatacttcgacatattaatgaagtaatcacattctacacatgactactccatatggaatactggggtgggggtgttccaaataaagagactgaggatttctcatgagaactcagtgtctgctagaaaatatctaagtaaaatattttacttatgtggaaggtgtggatgtttgtgcatcacaagtttcaagaatccctaaaatgtacaatggagatgaggagaaaatatcagaatttcccagcaccagaaatgaggcaagaaaaaattcagaggagttgtaaatgtgaaaagccaatggctggtcacacagcaacattgataaccttgtgccaggacaactagaataaatacataaacatacagattgaaagtatttccaatattagatctccctcatgtgagaactaaattataaagattgaagcatataagaaaataagctaccagaatttaggctaccagaataaattcgattacacataaatttctgatattgaaattctcacaaatgtttaagttggtagtggaagacaaaggacatataatcttgggagtcctagggccctgcccgctgccagttcctccatgctactacagctgatgctttctggaaagcaacacctcctggcaggaggccaaccagcacaaatatagagcattaaaccactaaagctaaggaccctcacagagtctattgcacccttcaccacctccactggaacaggcgctggtatccatggctgagagacccatagatggttcacatcacagggctctatgcagacaacccctagtaccagcccaaagccaggtagacctgctgggtggctagacccagaggagagacaacaatcaatgcactttggctcacaggaagccatgcccataggaaaagtgggagagtactacatcaagggaacactctgtgtgacaaaagagtctgaacaacagtcttcagccctagacctttcctctgacagagtctacctaaatgagaaggaaccaggaaaccaaccctggtaatctgacaaaacaagactcttccacaacccccaaataatcacaccagttcatcaccaatggatccaaacaaagaagaaatcactgatttatctgaaaaagaattcaggttagttattaagctaatcagggaggggccagagaaaggtgaagcccaatgcaagaaaatccaaaaaatgatacaataagtaaagggagaaacagtcaaggaaatagcttaaataaaaaataataataataataaaaaatcaggaaactttggacgcatttttagaaatgtgaaattatctggaaagtctcagcaatagaattgaacaagtagaagaaagaaattcagaattcgaagacaaggtctttgatttaacccaatccaataaagacaaagaaaaaagaacaagaaaatatgagcaaagcctccaaggagtctggcattctgttaaacgatgaaacctaagattaattggtgtacctgaggaagaagtgaattctaaaagccaggaaaatgtatttgggggaataatcaaggaaaacttctgtggccttgtgagagacctagacatccaaatacaaggagcactaataacacctgggaaattcatcacaaaaagatcttagcctaggcacattgtcattaggttatccaaagttaagacaaaggaaataatcttaagggctgtgagacagaagcactaggtaacctataaaggaaaacctatcaaactaacagcagattttgcagcagaaactttacaagctagatgggattggggcactttcttcagcctcctcaaacaaaacaattatcagccaagaattttgtatccagcaaaactaaacatcatatatgaaggaaagatacagtcatattcagacaaacaaatgccgacagaatttgccgttaccaaaccagcactgtaagaactgctaaaaggagctctaaatcatgaaacaaattctggaaacacatcaaaacagaacttcattaaagcataaatcacacaagagctataaaacaaaaatacaagttaaaaagcaaaaacaacaaaaaaaaacaaagtatagaggcaacaaagagcatgatgaaagcaatggtacctcactttttaatactaatgttggttgtaaatggcttaaatgctccacttacaagatacagaaccacagaatggataagaactcaccaactaactatctgctgccttcaggagactcacctaacacataatgacttacataaacttaaggaaagtggtagaaacaggcatttcatgcaaatggacaccaaaagcgagcagcagtagctattctcatatgagacaaaacaaactttaaagcaacagtagctaaaagagacaaacacagacagtatataatggtaaaggtctcatccaacagaaaaatatgacaatcctaaacatacatgaacctaacaccggagctcccaaatttataaaacaattactagtagacataagaaatgagatagacagcaacacaataatagtgggggacttcaatactccactgacagcactagacaggtcatcaagacagaaagtcaacaaagaaacactggatttaaactatactttggaactaatggacttaacagatatatacagaacatttcatcaacaatcacagaatacacattctattccacagcacatggaattttctccaagatagaccatatgataggccataaaacgagtctcaataaatttaagaaaattgaaattgtatcacgcactctctcagatcacagtggaataaaactgaaaatcaactccaaaaggaatcttcaaaaccatgcaaatacatggaaattaaataacctgctcctgaatgagcattgggtgaaaaatgaaatcaagatggaaatgtaaaaaatttcttcgaactggatgacacaacctatcaagacctctgggatacagcaaaggcagtgcgaagaggaaagtttgtagccctaaacacctacgtcaaaaagtctgaaagagcacaaacagacaatctaagttcacatctcagggaactagagaagcaggaacaagccaaacccaatcccagcaaacaaaggaaataaccaagatcagagcagaactaaatgaaatcgacacaacaacaacaacaacaccaacaaatacaaaacataaataaaacaaaaagttggttatttgaaaagataaataaaactgatagaccattagcaagattaaccaagaaaagaagagagaaaatccaaataacctcactaagaaatgaaacaggggatattacaactgacactactgaaatattaaagattattcaagggtactatgaacaccttttggcacataaactagaaaacctaggagagttggataaattcctggaaaaatacaaccctcctagcttaatcaggaagaagtagatacctcaagcagaccaataaagcaagcagcaagatcgaaatggtaattttaaaattaccaaccaaaaaaaccgaggaccagacagattcacagcagaattctaccagacattcaaagaatgtcttctttcattcaaagaagaaatgataccaatcctttcacactattccacaagacagagaaagaagaaagcctccctgattcattctatgaagccagcatcaccctaataccaaaaccatgaaaggacataaccaaaaaagaaaactacagaccaatatccttgatgatcacagatgccaaaatccttaacaaaatactatctaactgaatccaacaacatatcaaaaagataatccaccatgatcaagtgggtttcataccagtgatacaggaatggtttaacatatgcaagtcaataaatgtgatataccaaataaacagaattaaaaaaaaactcaaatgattatatcaacagatgcagaaaaagcattcgacaaaatctagcattgctttatgattaaagctctcagcaaaataggcatacaagggacataccttaatgtaataaaagccgtctatgacaaacccacagccaacataatactgaatggggaaaaggtgaaagcattctctctgagaactagaacaagatgaggagcctactctcaccagtcctcttcaacatagtactggaagtgcttgccagaacaatcagacaaaagaaggaaatagaggaaatccaaatcggtaaaaaggaagtcaaactatcactggttgctgacgatatgatctttcgccttgaaaaccctatggactcctctagaaagcttctagaactgataaaagaattcagccaagtttccagatacaagattaatgtacacaaatcagtagctcttctatacatcaacagctaccaagcagagaatcacatcaagaactcaaccccttttacaatagctgcaaaaacaaacaaacaaacaaacaaacaaaaaacttaggaatatacctagcaaaggaatcaaaagacctctacgatgaaaattacaaaacactgctgaaagaaatcatagttggagccaagcatgttggcacatgcgtataatcccagctactcgggaagctgaggcaggagaatcgcttgaacctgggaggcagaagttgtagtgagccgagatcacaccattgcactcccacctcagcgacaagagcaaaactccctctgaagaaaaaaaaaaaaaaaagaaagaaagaaaagaaatcatagatgacacaaacagatggaaacgcatccccatgctcgtggatgggtagaaccaatattgtgaaaattaccattctgttaaaggcaatctacaaattcaatgcaatccccatctgaataccaccatcattcttcacagaattacaaaaacaattctaaaattaatatggaaccaaaagagagccatgtagcccaaccaaggctaagcaaaaagaacaaacctggaggcatcacagtacttgatttcaaactgtacaataaggccatagctaccaaaacagcatggtactggtttaaaaatacgcacatagactaatgtaacagaagagagaacccataaattaacccaaatacttacagcagactgatcttcgacaaagtaagcaaaaaataaagtggggaaaggacacccttttcaacatatgatgttgggataattggcgagccatatgtaggggaataaaactggattctcatctctcaccttatacaaaaatctactcaagatggattaaaaacttaaacctaattcctgaactataaaaattctagaagataacactggataaacccttctagacattggcataggcaaggatttcatgaccaagaacccaaatgcaaatgcaataaaaacaaagataaatagctgggacttaattaaactaaatagcttttgcatggcaaagggaacagtcagtagagtaaatagacagccaacagagtgggacccctgaccctgacccctaaccttaaccctaatccctaaccctaacccctaaccacaactctccccctccccctaacccaaccctaacccctaatccctaacccccaacctctcttaacccctaactctaaatgttgactcctaacccctaactctgaccccaacccctatctccaacccctaaccctaaacttaacccctaacaccaaccttaagcctaggttcgttactacgtttgtattgactatgtcaatgttgattattatgatcgctgtcttaggactgcacggcagcgaggggattgtgcatcttatattaatgtttttgtgtcgaggcagtgcattagcactacaggtgcttgttacatgagcaaggggggtgtcatcttttgagtgccatgtctgcattaggaatgctgcatttgtcttccgaggctgcggtgtggatctcgcactgcggccgcctcaccttggctggggagaacctcggtgggcaggattcagaggggcttttggtttcccgttttccacactgaacccttctatctggtttctgaccctgattattcagggctgcaaacaggaaggattttattcaccgtcgatgcggccccgagttgtcccaaagcgaggcagtgcccccaaggtccgtgctgaggagaacgctgctctgccttcgcggtgtcccccgggtctgtgctgagcagaacgcagctccgccctcgcggtgcccccggcccgcccgggtctgtgccaaggagaacactgctccgccttcgctgtatctccgaagtctgtgcacaggagaactcagctccgccctcgcgatgctctccgagtctgtgctgagcacaacgcagctccgccctcgcaaaggcacagcgcgggcgcaggcgcccagaggcgcacaggagacctcaggcccagactccactccccagctgtgaaagggtaagaattgagggtggctgaggctcggggttgttcagggcggggtgggctctggacccagcaggcccggcacccaggtcagggatccaggggaggccaggtggggcgaaggccaagaaggggccggggctggtcaggaagggctcctggtgaccagaacactttgcgtgagccagcgtgggaggaaggtgggctggatgagccagggaggcgccgggaggggccttggcagaggcgaccccctccgtcagcccccaggccactgaaccctgggtagcaagaaccggcaggggaggctgcagacggaggagtggaggctccttggctttgggggctctgagcagaagcatctagggggtccctcaagagacccccaaatgctgccccatggtgagaaaacagggagaggccctgcagggaccccccggggttacaaagggctgccactgtgagaaggcaacgctgctggctggggctgggctttctacctcaccaagcctcttcccacccaaagggcccagagaggggcagctgcccccccagcgggcacagcacctcctccctgtgtgatggggtggggcccacagtctcctttctcgcggcctgcctgggctgaccctgggtcccagctcggccatggggcttcggcatgtaaagcccttggggggcagagcctcccgcccccgccagcttctggctctctgtgtcgcccccagcactggactggtgccttggagggaggctccgccctcctccacatcaacccgctgaggagttctgtcttcccagggttgtgagggaaaccagctctgcaggcctatgtccaagtctaggcaccgcctcctccagggagccttccagacctgatctgtgtggcagaggcccagaaggacctgggtgtggggatcctagagggaggcgggggacccagcgtgaggagagagggtcccagtgcttcctcctgagtgagggtcacccatctgactccggctgcacagagccactccctctaagcgctcctgctctctgccttcctgcattagctcttgcctgtacccggcccagcaaacccctgctcatctttcagacccaagttcaaggccccctcccactccgggtggctcatcacctggcctccccaggcagagaggctaggctcctgctcactggggcgtctcccttgcccactggcacgggactacaaggaaaggggttgacccccaccctcccccgccatgcccaggagggtgcagacacaactgggaaggtgctagagaccccggggggaggctgggccagcaccaggcattggggggcaggttcccgtctctacaccccagccccaggcggacagcgcgtgcccctcccgctgccccacctgtcacccacctgctggccccgggctgtctctgctcctggctcccctcccagctgcgtccccagctgcctctccagggaggagtgacagctggcctgtgccacaccctcgagcccccccggactaccccctccctggggcaggacccctgcctgtggcacaaccaaggggcctgctgatgggggctcatgtgagcagtgcctcagctgtgggtgtgggtgctgccagctgccaccgcctttgccctggtttcccagatagaccccgacccacactccgaagctgtatcatgaacgctgtggtgggcggctggtggggagcggggttgccgtcccactaccctctggaagcctcagccatgaagagcccctgtgggcaccttttcccggcacacggtgctgtgtttctccactcttgggctctgcagtgacttgaggggtcaagtctatgatcccacgggaggctgggctaatgaggggaccagagacctcagtgctgtgcagggagtcctgaaccaccctggtggaaggcccagcccaactccccagtcctcccgccagctccctgtggtgtccaggagacctgtggtcaggcctggaggagaagctcctcctcccctcgacatcctccctgcagcccttgctcttcaccagagcctcctgactccccaggaccccagagaggactgaccctctccagccgacctctgggctcaggacagctgggcggggcagccacaggagctgcctgtagggagcagagtcaggacggggaccgagccggacacccattctggaagtgtctgcacttccaggcaggggaaggacggcagtgggtagctgggagtgctgggccgaagatgggcattgtcaggccctcagtggggactgggaggtagaggtggggaggtctgtggaggaaggagaagaagggccagtgtcccgagttgggggtggttggcagtggacgaggccgacaggaacagacctgagcttggggagctccactcagaacgaggcatccttcagggttctgtgcatactggtgtccctggctgggggccgggccccgaagtggagcctgggactgtgagggtgggggggtgtgctggggtgggaggtggatggagccccccccccaccgcccggccgcttgggctgaaccttggacttcggagccggaacagacataggaaatggcctaactgcatttgcgcaggaacaccaaatccctcgcagctgcacggggctgagccagggccacgggcggggtcggccatcccagagtcctgacagctccgtggtgtatgccaaggggcctgggccgctgaccgaggggcgcctttcccaggccagaggcccccaccccaccccaggagagctgcccccctttcagttcccagaacggagcccggctgtggaatagtgatgcggtgaggtcatggggagggggcccgcatgactcatatcctggggtaggggaaagggaggagacggagaaggggcccagaggcctccacgtcctcagctctgctgggtcagaggccaggggctggcggggcttctccccagcactgggttttaggggagacaccaggagatgcttactctgcatccccactctgtcccccaggcccctagccagggagagctcagtcagagtgatcctccaggggcccagctctgcatggatgttcccagagtacacacctgggcctcgtgccagggccggcaccgccgttgtcagggctatggcaaggcaaacagtcaatgtttgcctcactaaagtgaggctgcagcaccctgaagggatccctggagggggacgtggtccccttgttcccaagcttgtctgcacatgcacgtggatgtcaagggttcccgtgtgtgagcacgtgcatatttgtatgtgcatggggtgcgggcatgtgtgcctgtgtggccggagcgtgggctcgtggagaatgtgtgtgagttgggtgtgcacctgcatgtgccccaggcctagggagtcccgcgcccggccgcactccttgtgttgggcatgagctgtgagcagagtgagggcctttatggggctgttggggcccggactcgttgcccttaggggtggacctaaggaaacgtgtgcacacgggcttctggggtctctgtgccaatgtgtgcttccaagccacgcctcccctatggcttggtggagggggtctgtggagctggagtgagggccctggacccattggaagcccaggtccaaggaggagcttgggctccatctcatgccccaggcccaaggacacacaccccagctgagaccttgctcacatagaggggctgggacatgggaacatggggagcaacatggccaggcttctcctccatggaaaccctccacctcctcaatactctgccccagctctgcgccgccctccatttggaggggctgggtcgtgagtgggggcgtgagtgagcatgagggcccctgcaccccaggctctgcctccccacgtggaacgaggcccagcagcccccagccaggtggctactactgcattcaatcagtgcccctccatctaacaaatactccctcatataatcagtactcctccatccaatcaatattccttcatcaacacctttctatacaaccaatagtcctccatctaatcaatgctcctccatccaaccaatactctgcaatttaaccactgtccctccatccattcaatgtccctccatccatcccatggtcccccagccctaccccatgagcagcatggaggcagacccacatctgtcttgtgcgccatcatctccctgatgctcttcaggaaagggaggtgtctcacaattgcattgaatggaggaaggcacatctttccagtgatccccactctagggctgcattgggaaatcgctcccagggaaaacacaaacacaaagcagagggttgcccagtgtgaccctctgatgtgaccacggtggctgtccactaaggtaatcctgatgcttttcctcctctgcagactgctggccagacccccaagctagcccgccaggcctccatagagctgcccagcatggctgcatccagtaccaagagttggtgggagacgggtgaggtacaggctcagtctgcggccaagactccgtcctgcaaggtaaggtcccctccaggggcaaggctgggctgcagagccagcactggggagtttagtagcaggccaggtttccttgttaagacaagcgtgggactgtccaggatgaatgtgggcagacagaaccctgaggtattgcagtagggttgggttcacccttgctggtgtagaaggctgtgttgtccgagtggaggtggatggcacctttattcctttccctgcttcttccactgggatcgcacagaaaaagttttggtaggcagatcccaggccccctggccaggtaaggcaaggcaggagagaagggcccagggcttctactccccaagatccaggggtctgcccttgtgacatacccttctgctgcccgcaggatattgtggctggagacatgagcaagaaaagcctctgggagcagaagggaggctccaagacctcatcaacaattaaggtagagcctaaatgtggttggtgcaggcaggaaatattaacttatttcattgtcacacgaaaccagaagacataaaacagttaaaataggccaggcacagtggctcacacctgtaatcccagcactttgggaggccgaggcgggtggatcacgaggtcaggaggagaccatcctggccaacgtggtgaaacttggtctatactaaaaatacaaaaaaaaaaaaaaaaaaaaattagccgagcgcaggggcacatgcctgtaattccagctacttgggaggctgaggcaggagaatcacttgaaccagcaagttggaggttgcagtgagccgagctcgcaccctgcactccagcctggcgacagagggagactcagtctcaaaaaacaaacacacaagcaaataaaaaaaacaaaacaacttgacacacttagaaaatgaaggtttgtgctattggttttcttttattttagaaaaacaaagcattgtttaaatatttcttacaagtacaaatataatttaaatttaataaatgttcaaaaatatctgtaattaagtttcattcagcagacatatgtctaatagagaacttgctaagtaagatataaaggatgattacatgaaaaaatcacaaaattgtcagtaagagtcttaaaagtcagtgataggacagtagttaaaagatatcaaatagttatttattcttaaacgttaaacaggatattaatagttttaataatcttgaagtttgacaacactgtgaaaacattacagaccacttttatttatgaaaatacgtgcaaatagcaaacaccagttgggcttaaggctgctacttacttacccagtaagtgacaaagctggaattcaaaccaggtttgagctataccactactacccttgaaaaggtttcattacactcagctttccttaatttcttaaactctttttttttttttttgattgagacagaatcttgctctattgcccaggcgggagtgcagtgacatgatcttggctcactgcaacctctgcctcccagattcaagcaattctcatgcctcagcctcccaagaagctgtgattacccgtgtgcgtcaccacacctggctaatttttgtgcttttagcagaggtggtgttttgccatgtcagcgaggctgatcttgaactcctgacctcaggtgatccgatccgcccgcctcggcctcccaaaatgctgatattactggtgtgagccaccactcctggccaatttcttaaacttttgattatactaaatatggtccttctgcgtgataacactgtttttccttttataaaattaatctcttaaaatactttaaaattcaaagtacactttttagattctttaaaatactctttgccatgttcatggcctttagatgtgtgatcatagcctatttgcttttcattgacttagtttcatatttctttgcctttttccccctacttttccttatagaactatttactagtaatgaaatcattttaaagaatacactttttattccacctgctaactgttaagagaatgttttataatcactctggtcatggcctgtaagtttcttttctaaactatcttttcaggatacatatttactaacttgctttcaaatgaatatggtcatgtctatgcagcaagtttcttttctttcttcttttcttcttctcttttttctttttcttttctttcttttttaaggcaagatttcgctctgtagcccaggttgaagtgcagttgtagaaacatgactcactgtagcctcaacctctctggctcaagtgatctgcccacttcagcctcccagccaagtagctgggactgcaggtgtgcaccaccctgctccactaagttatttagttttttgtagacatggattctcagtgtgttgcccaggctagtcttgaactcctgggctcaagccatcttcctgccttgacctcccaaagtgataagattacaggcttgagacattatgcccaacctctttttctttttctttctttctttcttttttttttttttttttttgagacagtcttgctcttgttgcccaggctggagtgcagtggcatgatcttggctcaccgcaacctccacttcccgggttcatgcgattctcctgcctcagcctcccgagtagctgggattacaggcatgcaccaccacacccagctgattttgtattttttagtagagacagggtttctccatgttggtcagcctggtcttgaactcccgacctcaggtgatctgcccgccttggcctcccaaagtgctgggattacaggtgtgagccaccattcctggccctctttttctttttaactaagcttatttatctcttccccagcttgagtctgggtcctactgtcttggtcagagtattttactatattgacctggacaattctgccatcatgaaccatattccaaacctaaatatgtaagaacatagaaagattattttagcaggagaattttaacacacacacacactttattctgaaaatttagcaacaaaatgaaaggtgagttgtggtagttgatgtatcaacaaatagaaagaagaaagcctgtaatctgtttcagaatgctatttctggggctggtaacatcaaaaataatcaaattaagtgttaacttgctgactcgtaagattttctctaatttagaagttggagaacatatatactcctattaccactttccatctttctcaaatatagtttttatagttttctgttggcttcatcatcgtattgaaagattattaatcacttacatatatgtagttttctgttaagtcctgttcaatatattacaaaattttgatctgtgtatgtaatatcaattaataagatggtgttagttaaatcagattacgtgttcattcattaagtcattgttaatacttcacagaatataaatcgtgttccatgagcatgaatttctctctgaattccacataattgtcttaaaattatgcaccatttattgttaagagtgaaagattatgtgtcatttattgtagtggtagaagaaaataaaaccaaaacagaatccaatccaaaagcttaggtttttgttgctactacagtaattacatcttcatatacgaaggacagcacattattactgtccaagaatggtgcctcggacaactggttgcttacactgttttcagagatgaaataggaacataagcaggaagatttttgtctaaatatgaagcaagaaaggcttaaatgtctttattcaggggattaggcatcataagtttttttttttttagagaaattgttttcatgatatttcctatctccttttgtcactttgcttttgtcggtaaattttacaactaaataaggattaccaggcataaaaagcagcagacaatcatgatgcaaactgaaaataatcaatcaaaactgacccagaacttaaatagatgttaaaattagcagaggaggacattaaaactgtttttatacatgtatctcatataatcaaaacattaaatagagacatgggagataaacaagaaaagccaaaatcaaactttcaaagacaaaaacatttgagatgaaaattacattggatgaactaaggcagattagaaactgcagaagaaaagattagcaaacttgaagatacaagaacagacactagctaaagtacaaaaagaaaaaaaaatgttaaaaagtgatttttaaaaagcatcagtgagcagtcaggcaacttcaaatggcctaataatatgcaggtaactggagtccccaaaggagaaaaaaaagaaagagaaaaaaaatacttgaagaaacaactgctgaaaatgttctagccataacaagacctattaactcacggatccaagaaactcagcaaaccccaagcacaagaaacatgaagaaaattacactaagggataacataatcaaattgttcaaaatcaaggaaacattattaatagcaggtgtataaaaagacatgttacctatagaagaacaaagataagaacaacatcagatttcttttgagaaacaatgcaagtgagaagacagcggtacatctctaaagttctagaagaaaaaaggccaactagaattctatgcctagcaaaaatatctttcaaaaatgaaggtgaaataaagacacaccagaaacataaataatgaaataattcatcaccaggagaccttcactgcaagaaatgttaaaggatattcttcagaaacaaaatgatgtcagatgaaaatctggaccaatacgaaggaataaagagcaccaaagtggtaactatatgagcaaacatcttttaaattttttattatttaaatctctaagagatacatgtttaataaaaaaacagcaaaatgttacagagtttataacatatgtaaaagtcaaatgcatggcagcaatagcacaaagtgcaggagggaggaaaagaaagtaaatgaaggaatgcttttattatagatgaagtgtacaatattacttgacctctctaaatgtgcactataatcttaaaggaaccacaaaaataatttttaaaaataggtaaaagtaataaaaagaggcaaactggaatcataataaataatgtaagctgggcacggtggctcacgcctgtaatcccagcactttgggaggccagggtaagcggatcacaaagtcaggagatcgagaccatcttggccaacatggtgaaaccccgtctctactaaaaatacaaaaattagctgggtgtggtggtgcacacctgtaatcccagctactcaggagactgaggcaggagaatcgcttgaacccaggaggcggagactctagtgaaccaagatagcgccactgcactccagcctggcaacagagcgagactctctctctcaaaaaaaaaaaataaataaataaagtaaaagcatgcaagaagaccaggtgcaatggctcacacctgtaatcccagcactctgggtggccaaggcaggagactcacttgagctcaggagtatgagaccagcctggacaacatagtgagaccccatatataaaaaaataaagtagccgggtatgatggtgcacaactgtggtctccactattgggaggctgaggtagatcacttgagcctagcaggtcaaggctgcagtaaggtatgatcacaccactgcactctagcttgggtgacagagcaagaccccatcttggcaggtgggggatgcaagaaaaatgcaaggaacagatagagataaatagaaaacataagaagacaatcatattaaatgtacatggtctaaatacccccaattaaaaagcagaggttttagaccatatacatttaatgtgattgtcttcttatatgtttttatcagagaaataaaactatcgccttcaagaaacacaagttaaatacaaagatgcaaacaggttaaaataaaagaatggaataacatataccatgcttacgctagtcaagagaaagctagaatagaaatactaatatcaggcaaagcatatttcagagttaaacacaacatttttccactatttgcagtcaaaagtatcgttaacactctctttactctgctcaaagttacagagttcttttgtataaacattagaacacttatcacagcctgcctataatggagaataattccatgttgtatactatacaacactcttactaaagtccattagacagaaatatgtagcatttgagacatcttccaattataaaactctatgcaaacaaaaattaacaaagcagttctgagactattatattatcctgtgaaggagggtctgtctgtctgcacagttggtcctaggctggcttctgaggacttgaatttcaagagggttccataactggtaatcatggtttactgtatctagactatggaaataatgtggcttatcctgctattctttttgtgagtctggaaatttcacacatgctaggcagagtacacatatgtgacccagccgagataaaacctgtgtttcttgggaagtcacataggttgttgtattttcattaagggggaaagaaggtagtctgtgtgatcctcatggaaggcacagcacataaggaagccggtacatggatttttccagactctgtcagtgtcttttgccattgagatctttctactatatatccatactatgttacagtaataaatcttagccattacaaccctaagctgatcccatgagtccttctagcaaatctccaaacatggaggcagtcttgtggatccctgacacaaatatagtgttgtgatctcttaaggtttatccttcctcttaaactataaagagctggctgggcacagtggctcacgcttgtaatgccagcactttgggaggccgaggcgggtggatcacgaggtcaaaagattgagaccatcctagccaacatggcgaaaccccgtctctactaaaactacaaaaattagcagggcgtggtggcacacatctgtagtcccagctactcgggaggctgaggcaggagagtcgcttgaaccagggaggcagaggttgcagtaagccgagatcgcaccactgcactccagcctggtgacagagggaaacttcatctcaaaaaaaagaaagaaactataaagggctgggtgcagtggctcacgcctataatactagcaccttggcaggcccaggtgggagaattgcttgggcccaggaattgagaccaacctggacaacagagcaagaccctgtctcttaaaaaaaaaaaaaaagaaaagttggccgggtgtgatggatcacacctgtagtcccaacactttgggaggccgaggtgggcaaatcacaaggtcaagagttcgagaccagccaggccaacatggtgaaaccccatctctatcaaaaaaaatacaaaaaattcactgggcatggtggtgggcacctgtaatcccagctacttggaaggttgaggcaggagaatcacttgaacctgggaggcagaggttgcagtgagctgagatcacgccactgcattccagcccggtgatagtgtgagactccatctcaaaaaaataaaaaagaaaagaaaagaaaagttagccaggtatggtggcatgcatttgtgatcccagctactctagaggctgagacaggaggactgcttgagcctaagaagtcaaggttgcagtaagccatgatcatgctactgcattccagcttaaacaactgagatgctatctcttaaaaacagaagtagaagcaaacaactataggggaaaatgagggatacatactttaagaatttttaaaaatttacatggaaaaacaccaggattctatagaaaataaaacagtattaaataactatttataaaatagatactagcaaattaccttacgtaaagattcaagtcagtaacttaaaggatcttacataaaagtactttccgttggttggaagagagatttttactatacactgtttttcaatttttttagacaaattacatttaaaagtttaaatttgcttatctacattcttaatgtgaattgccaccttactataggaaggctatttttgttcctgcagtctacaaaaagaacaaaaatattaaaaacgtacaactcttctcacagaactaagttggttttatacaaagacatctggcacaaaatacaatgatatttcaatatagaattacagcaggggatgagggtggagaaggaagagattgccagttctaagaggggagacaacagaagtatttttttaatgtcttattttaagagtaaaacacctgcttttttttgagatggagttttaggcgggagtgcagtggaacgatctcggctcactgcaatctctgcctccaggattcaagtgattctcctgcctcagcctcttgagtagctgggattacgggcacacgtcaccacgccaagctaatttttgtatttttagtagagagggggtttcaccacattggccaggctggtttcaaactcctgacctcagcctcagcctcccaaagtgctaggattacaggcatgagccaccatgcccagccaacactgaacattttgttcagaactagttaagaaaacagaaatatacattgggggtttatggattacttatttttggggtgcaatactgggaatagaagagaaaggagcttcctttccctctccttctttcattcattcattcattttgagaagaagtcctgctctgttgcccaggatggagtgcagtggcgaaaactcagctcactgcaacctccacctcctgggttcaagcaattctcctgcctcagcctcccaagtagctgagattacaggcacgcaccaccacacacagttaatttttatacttttttagtagagacagggttttgccattttggctaggctggtctccaactcctgacctcaggtgatccacctgcctcagcctcccaaagtgctgggattacaggcatgagccaccgcacctggccaagaaaggagctttagataaataaaatgattaaacatttgtagcatgtagaatgaaactattcccttagtaatactcaaattatccagatttccaagatgttggtagcaccccgagagcttcaaaagggaaattaaaagaaaaacgacgttacccttcctgaaacacagattcactgtttgccatattcttttctctagtaaaagatgaatagtttcccctggaaaaactaaaaacaatctgaggtatatttcagagaaaacaaaattgcttgataaaaatgccatgttaacaactgaggaaattgttttacatatattaattttaacacaggaataatatgtcaaaccaggatttctcaacctcagcactatcgacattttaagctgtatagtttttggtgtgggaggctgtcctgtatattgtagaatgtttagtggcagccctggcctctacccaaggggccagtaggacctacctcctcattcaagctaatgcactaaatttttcccttcattgacaaatcccattaatgcgtgtatttatcccattagttactctcttgtgttccaggtactttgttaggcaccagagaaaatatgataaagcaaaacagctattttcctcactctcatggtgcttacagccatggtgggaaaaatccataggaaaagactcacatacacaaatgcaggcagaataaaaaaactcacacaaacaaacgttgcagatgttgttaagttacataaaggagatatgcatggctgtgcatggtggctcgtgcctgtaatcttagcacttggggaggccaaggcaggtggatcacttgaggccaggagctcaagaccagcctggccaacatggcgaaaccctgtctctactaaaaatacaaaaattagccaggcatggtggtccatgcctatgatctcagctacttgggagactgaggtgggaggatcacttgggcccaggaggcagagggtacagtgaactgagattgcaccactgcaatctcagcctaggagacagagagagacgtctcctgttctcctggagaacaacaagtcatgatgtcagacaagaacttggattttggagacacgggtttgaatttcagtcattcattcttttattcagtaaatatttagcaagtactgacatgtcccagatgttgttttactcactggttatacaatgggagggagacagagaaagagggagagagagagagagagagagagagagagagagagacgctattctaaaagcttgaagtctaggctgtgcagagtggctcatgcctataatcgcagcactctgggaggctgaggcgggtggatcatgaggtcaggagattgagatcatcccggctaacacagtgaaactccctctctacaaaaatacaaaaaattagctgagcatggtggcaggcgcctatagtcccagctactttggaggctgaggcaggagaatggcgtgaacccaggaagcggagcttgcagtgagccaagatcacaccaccgcactccaggctgggcgacagagccagactccatctcaaaaaaaaaaaaaaaatgcgtaaagtctagatagactttaacccaggaataatccaaggaaatgaacaattacgaatgtgacaagggctgtgaagggaaagttcacagccttatcgaagtgtacagtagttggggaggttggccaaggcaagatgtttaggaaaggctttcctggggaaatttctctttgggttgaatcacagttaagtaggcaaaggggaagacagagggaagggaagtatggcaggcaggaagaataggcacttaatagctttgggatattgggcaggtcgcttgatctttctgagcttcagttttctcatctgggaaatgagttaataatagtcgtttagaaagtgtgatgagaccagccaggtgtgatggctcaggcctgtaatcccagcactttgggaggccgaggcaggtagatcatgaagtcaggagattgagaccatcctcgccaacatggtgaaactctgtctctactaaaaatacaaaaattacccaggcatggtggcgtgtgggaggcagaggttgcagtgagccaagatggcaccactgcactccagcctgggtgacagagcgagactccacctcagaaaaaaaaaaaaaggaagaaactgtgatgagatcaaaacagttaatgcatgagtgttctgaacctcgtttctccctctgctgtatctatgcagtttcttgacctgggctgtgctccaaagaggattctagcttggcttttgtgatagaggatggatacattattagacctgaaaagccagagcagggaggaatggtcccaaaaggaagaaactgtgcttgtcttcacaataaagagcagagaagtgggagaggtattgaaagctgtgggtggagttttgcaggtaagattgtgtgaaagaggtgagggaactacaatctaggggaatgtggataggagagtaaaagggaattctagagaacaatccctactgacttcacacaacttaagaaatgcaagtaaagggccgggcgcggtggcccacacctgtaatcccagtactttgggaggcagaggcaggtggatcacttgaagtcaggagttcaagaagagcctggccaacatggtgaaaccgcatctgggttagccaggcatggtggcatgtgtctgtaatcccagctacagaaagatagagaggtggctgaggcaggagaattactcaaacccaggagttggaggttgcagtgagccgagatcacaccactgcactccagtctgctggacaacagagcaagactcagggggtggggtgggggaaggaaagaaggaaggaaggaaggaagaaaggaaggaaggaaaatagaaatagaaatgcaagtaaagaatttcagtttgaaaattgccttttgtctactgaacatgagactgcttggaaactgggcaacgtggatttttataagttgtacaaagcacttagcaattttcaaacctctccatcctgcagagccagctcaatcacttctccagaaagacttactgagtcctctgcactgaacaggtgtcctgtgctccaggagagccctgggctggctcctagtgtagccattatgaccctggaatgcaccatctttcacatcactgcctggccttctagaatctcagcttcttaaatcaggaaattgtgtcttgttcatgtctgaattccccaagtgaacacagtgagtgggtgcttgacaaatctttgttggtaatgagcaaaaaaggggattctgtgcccaataccatgaaatcaatgcacagaagattcaatcaatcaagaaaggtgcacagacgctggccacacacactgacatttgttttcagatgttccagtccccctgacttccaccaacccattcattcattccacaagcatttttgctggggtggaagcagggccatacagggtgtgtaagtaacagatagggtgggtttgtataatgagtataaaaaacttctagcagaagatgacaaagtatatcaagaaagggctctcttcgaaatcacaccactgcactccagcctgggtaacagagggagattccatctaaaaaaaaaaaaaaaaaaaaaaaaaaaaaaaaaacagggatgggggcaagggagctctttttttccagttagcacaagattgccatttcagctagggattctactgcaactatctcccagaccctattctagggcccggggatagaaacagaatcaaaaacatattccttgtcttttttgggcttatattattgaggagagagaaataaacaatttcaaaataaacaatgtcatacagtgctaagtgctataaataaaatcaaacagaataacgaaagagaaagtagctagactggagggaaaagctgcttcagaatgagttgtcaaggaagcctctttgcaatcagaaaggtgagaaggatttagtcaggcaaatatcaggagtaaattattcttggaggaaagtaagcccatgcaaaggccctggggcagagtgggcttatttgataaagaggtaaaagggtcaggatatctgtagcaatagtggccaagggagggagaggtatgagacagaggaggtgagccctgttgccatggtgagggcatgaggatttattctaagttccagatacctggagttaaagtcccctgaactggacaacaactacaagccttcatatctcaatgctaccatctttaagcccctgttataagagctcagaggcttcagagatgacaggaaacaccagaacgctatggtggagcatatctaggtgccttctcccaactcagatcctttgactatagaaagacacagatttcaaggctgagatccacaaaactctagcaaatactgcacagacactgaccaatgacagcaggtgctgcctgtcaccctggagcaccaggcagggttccaaagcacccttgctgtgccagcctctgattgctggttatagggaggtctggggtagtcccaaaagctgggatgtctaaggcagctggggtcagtcaggaggctcagggcagtggcaggaaaatattttcctccctggtagagccacagcggggtatccaggctgaatattattggcgagaaggaccatggcacagcaccaagacctgcaggacaaactttgttggagctgaatccagaaaaacaatcttcttctaaaccactctcctgcccctcatttaattattgtgcttttgggtgcacttggactactctgaaacattcagaactctgtcaaaaaaaaaaaaaaaaagacctctctcctcagcacctctcccacttgggcatcagtcttggcttcctctctacttgctttcacttgctccttgtggcagagattgccctcagcagatcccttcccttaggttccttgctgtcaagtggaggctagggagcgagattatggccaatagaatgtgggcggaaccacagatctgagcctgaggaacatcccacaggaccctgagctcttcctccagctgctgcagtggccttggaagccatgtctgttctagaagtgtagctacagatggagaaggcccatgtgctagctagtctccaaagatggcgtatcaggccattcttgcgttgctataaagaaatatctgagataagttaatttataaagaaaagagtttgtattggctcattgttctgcgggcttcacaagaagcatggtgctggcatctgcttggcttctaaggaggcctaggaagtttacaatcatgagcaggcacatcatgtggccaaagcaggaacaaggaagagagagtcggtgggtgtggggagggacatgccacacacttttaaataaccagatctcacaagaactcactatctcaaagacagcagcaagccatgagggatctacccccatggtcaaaacaactcccaccatgccccaactccagcactggagactgcaatttaacttgaaatctgggtggagataaatatccaaattgtatcagagggccttccctcgaaccaaacctcctggtttccaggtcccctttcttgctgcttctgggctggcctcctgggaagccaagactgcagtggctctgatgctgcatgggggctgaggctcagccatgaggaggctcgcagctgccactttggtcttttggaaactttgctcgtgagagtctccccgttgggccgcagccaccatgctgagaaataagggtcatgtggagaggccacatggaggttttctggtctagagcacaactgagctcccagaaagcagccagcatcaatggctgggcatgtaagccagctggcatggacattccagaccagtctgtccttttgtcaccttagctacagggaaggcccatgaccccagaagtgcccatcattatgctgaattcccgagcctcagtggtccaccgaggtgtggaagcatgtctcacaagggtcagatggagttctggcctggattgatgtgtagaagctggagagagaagctgggtttctttcagctggggtggctctgctgggatgtggtgggccttttgggtttccaggtggtcattttccttatttgcagtagaaggaacgaggcccatatagagaatagagcaaattaaaaggagagaaagagaaaaaagtaaggagagagggagaaagagaaaaagaaggaaaagaagaacggagggaaggaggagaggaaagaaaaagagaaggaaaatgagaaggaggagaggaagaggagagagagagagagagagaaaataacttacttgaacctccaaattcaggcataccatggtctttgcagttataaaaatcaataagtcacccttcagctgaaacatgtctaagtggagtttcagttgttacaactgacagagccctgcctagcacaaggaataaacaatgttcagcagtggcatgagaacaagggacagcctgtttggtgggcagcatggcaaatgactgtctggaaaatatgatgcttgggctggagggcaaagtggaattcaccagcatgcagggtggaagtacgaccctagcagacggaacagcactggcaaaggctcagaggcaagaagctttacatgtgaaaggatacatttttagaacactaaacattctccctgttatccaaaacactgagtttctcttcattttttggccaggtgtggtggctcacgcctttaatcccagcactttcggggctgaggtgggtagatcacctgaggtcaggagctcaaaccagcctgaccaacatggcaaaaccccatctctactaaaaatacaaaaattagctgggtgaggtggcagacacctgtaatcccagctactcgggaggctgagggagaagaataacttgaaccaggagtcagaggttacagtgagctgagatcgtgccactgcactccagcctgggagatgagacagagcaagactatctaaaaaaaaaaaaagactgagtttctcatcattttttgaaattgagagttttctctgtatcgataagaccttataatgcaaaatataatataatatgcagctaggtctccacagccttcagtctttcccagggagggttccatgagctgcttgtctggtggggatggtggttttgagcaagtagttggtgtcctgtcttacccaggctctttcccacaaagagttgggaagaattaaaaactactggaaaccaagatctctccctgatgttgactttcagagctcagcctcatcagcacaggctctaatcagctaagcagctgcctcgtttcatccagccagagccctgatctcaggggatgatagtgaggaaatgatcctttcacatgcctggctcctgcaaaattgtgctaagaggattttcctcaaacagtttagcacagagcgaggtttcctgatccagttagcaaatattcttctgtttgaactcactgaccctcctttttctgaagatgtattttaaattggatttgcttcactgacacaaatggaaaacttgataagaaaatcggtgggattttgctgcacccactgctgatatcaagactgaactctgtattatagcaagaaaagctctgttctgtggctacaggatacatgctgagctcccagccaccagccctgccaatgtgctcagcttggcacagggcagggagcagggtagaggggaggggatggggaggggcaggtggaaaggctcaggtgatgagccagccacatcacctcaagcacaggacccctgatggtggccctagatcctcctcttgaaatccaaagctcagtccctctccccagttcaggagcaaggaggtttctggcaggttaaaatggctaactcaagagcttgccacctttgaaaggcagcactgtgtagacagaggcagaaggatgggcttacgagacagtcctggcttcaaatccttctctgacttaccagctctggaaccttaagcaagtgacgtaacctctctaagcctcagttgcctcatctttaaaatggcatccctaatccttactatgaagagatatcatgggtaaatgagatgctgtacttacgaaagggcaagtccctgtattggtcaagtgtttttacagcattgctgcataacacacagccccaggggctcagcagctcaaaacaagtgtttatttcttgctaataatttgcagtgagctgggaagccttgcctcggactgggggccaggctctgtttgcttctgtgtgtctcattcacaggccagtggttccccggagcttgctcttctcattgtgcaggggtagggtcagtgctgccacccaacaccacattcagttagagcctccagtcagaccaggcatgcactaactctgctcatgcatctctagccaaagctggtcatgtgcacagcaagaaatctgctctgtcctgtccacagggaagtcgcaggaatgtggaaaggccaggaaggattgtgagccaataatacatcttgacaatccacaatagatggaagctattattgattcattatctcaaaatggctccaccagccaaccccttctatccatccccagtgctacctcctaattgaggtcctcgacgctttttgcttgcatggctgccagagcctttgggcaggtctctgtgttgatgtgttcacccccactcctatctcctccatccaacgctctaccaccaaggcaatcctcctaaaacacaaccacagtgttcttcacactccctatgattccctgccacccacattattaatcattaatccaattaataaaaattaatgtactaatccccagctcctcagtgtggcccttcacaatctgcttgtccagcctcgtctcttgcctccccagctttccccagcagacccctctcccacccattccaatgccatcctcttctcccagcctagttctttcaggccctgtgcgtttgcacttgcccctgtctgaaatgtccttcccacttcttcttgaagggggtgagtgccaactcacctttccaaccccacaccaatgcacaccaggatctccccaagactccagggtagtagtcaccatctgtatttctgcagcacactgcacctgcctctagcacagctcgacagcccactgaagtgaatgatctgttcgatcggtgccgacttgcctttctttcccagctgcaaaccacccaaggtgaagtcatcttagcctcttggagtcagcctgactggggtgaacccattgatatgtattgcataaatgaacatatcatgacagtagtgatgagggatctccagctatccgtgtactctctatgcttcccagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacccgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatggcttctgactgaatgctgtgcaatatccacaaaccatccagattgtggtttataaataccacccttcactaaaaggactcagagctccttgtagaaatggctgatgctaaggctggggtagggaagtacaaggtgagcccagagtgctgtgtggtgccagaaagcaaggaagcatttaaaaaatgacagggacatgtcaaaggacacatcaatcaacttcaaggggcttccactggccaaatctaggatgatgtgagcatccaaattaataatgataatggtagattatagtctattgaataaaatgggaacctatagctatagaaagaaagaaaagggaaggaagaaaagaaagaagaagagagggagggagggagagagggagggagggacggagggagggaagaaggaagaagactttcttacagtagaatgccaatgaataaatacagagggaataatagaaaactccatttgcaaacatgatcataatagtttattcaaggaagaatcatcactgagtgaaaatttaggaaggtaaagtatgttttcattgtctcatagcacttccactcatatggtttattaattgcaaagagaaaaagtggtaacttaacagtagagaaacccagcaggtcctcccttaatgagctgaacaaagttaacaacaccaggaataggacaaatgggtgccaagtgtttcttgatgtgatacactgagaacacagcattgcttctgtagcattccggtccctggaggaaacatcagacaaacacagatggagggaccttcaaggactgacctgaactgttcttcggcgtcaaccccatgatagacaaaaagaggcagaggaactgttccagattaagggagactaaaaaggtatgacagctggatcaggggaaacgtgccttaaagggcattattgggactgttggcgaaattttaagtgaactgtatattagacaattatcaaggactacacgattgtatggcatcaacctcaaattccccgaacttgagcactagagtcttcttgttctgatggaatatgttctggaatgtttaagggagaggagaaggatgtctgcaactgaatttcaaatggttcagggaaagataatagagtagaatagactatatagatggagaaagtaaatgtggcaaataacaattggtgaaggtgggtgaaggtcatgaaagttctttgccttacaattaattcttctataagtctgaaattatttgaaaataagagaaatgctttcagctgtgaataacagaaagcctgactacttgtggcttttgcaataaagacatttagttatgtaacataacaggatttaagaggaagaaggcaaggacttgaaaaggctcagtgatgtagctgaggccccagattccttttatcattttgtccaaaggctccaccttcctgaatattactgctttatacccttggagcttcatgatcacaggatggctgttatagctccagccatcatgaccaagttcagactccaggaacaagatggaggaagctatgtcaaggggggcttttcttgatgtgtctctcgcctttaaccagtgaagaaaatcttcttagaaggacacagcagacttctccttatgtctcattatccagaagtggaccacaggacagtccctactgtaaactctttcaagtatcaggcaaaaaggaacaaaaggccccagcctggcttaaaccaaccttgagtcatcacctgacactggacactttgtttatccaagcaaaatcaggattttctgttagcaagcaaaggaactgctcatgggtaagaaattaacagtgtgtgccataattcatatttgtcgccaagcatcttctcaggctgacactgtgccaaacaagggattatagagatgaagatgcagcttccatccctgaaagctcacagtccattctctcagggcaatcccggtaacctcctcatcacaatcatccatccagatcatggaagtccctttactccccaaataagaaggagtagcaggaaaaagtgacctcatcaagctgactcgagtttttccaaaagcaaataaataaataaataactttttaacctgcacagccaaatatcaaataaatacatgtgtgttttttgggggggttggggggtgtttttttttctgagcttcctgtggtattgaaactatctcccacttcctcctttttgtctcaaaagatcttaagcattgggccagacacagtggctcctgcctgtaatcccagtactttgggaggccgaggtgggcagattgctttagcccaggtgttcgagacgagtctgggcaacgtaaaaatagcccatctctaaaaaaataaaataaaataaaatacaaaaattagccaggcatagaggtggatgcatgtagttccagctacctgggaggctgaggtgggaggatcacttgagccccaggggttgaggctgcagtgaaccatgatcatcacatctgggcaacagagcaagaccctgtctcaaaaaaaaaaaaaaaaaaaaaaatctaagcatccattcattttagttcatttgaggataattattgatctcctcttctaccaccactagggatacagaggaggagcaaacagacattattcctttctcttgaggctcacagttaattggtaaagagggaccactattcagaaagtcccacacatcattgtatgatcaaaagctatgacagatgcaaggaaggaaagctggatggtgttgtgaggcttcatggcagggacaccagacctggtctagaggtgagggaagacttccctgaggcactggcttgaatggagagctgaaggaggaataggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgctggtggtgttttgttttttgtctctaaatatgtgatttagccataggttgatgaatatttttcttggttgagaatttcagaatggcattattattcttaacaaataatattgtttattttacctttcatgctttcagatttcaatatgattaaaggtaatttgatttttctagtgctaattgaaatatttttcccttcctgattgtttactatttctctaggagatatgtagatgtaggtttatctccatcgtagcttgcttagcatgcatagaagttttgaatatgtggattagtgtcttacaaaactctagagaactttcagccaaaataccatcacatattgtcccttccccgttcccttcctctatgagaacactcactaaacacatgctacactttctcactgtatcttccatgtctcttcatgattctgtccacattgtgcctttttttaaattttctgtaatgtattctgaaatatttatgagctctcaccatggccatgtctaatctgatgagttcatttttgagtttttaatttaaaatactatatacaaactacttttcaaatttactacatcaactttttagtctcctaaaaatatattcctttttttaaattttttgaaagcaaatgtgctttataatctaacagtgatatttctactaatgaacctctgtggatctgtttgtactctttttctgctttcctttcaaatggtggaatatcatttccttgcgtacttagatgcctttgaatgacaaagatttatttttctctgaaaattattattgtgcacttttgcatattagtaagaagaaaatttgccaaagagaatttgaattttttgtgagtctactaaaggcaccaccattctgggaccacattatattaattcttggcctaaaggtgtttggacgtatgtttggacagcacatttaaacaatttttaaattaattgctgtaaatcattaatgattgagtttctttaaatctgtcaaatctcaagtcatttttatttgccatttccagggaatgtgaaatgagactaatttacctctgattcttctttatactgaggagataaattttggtgctagctttagggaagagctcctgtgtgatgccctatcttgggaaacactatgtgtttctttactgtcctatgtgatgtatgaccataggaatctgcactcattcattttgctacatgtccgtagggcaaaatcagtatcagtgtttaggtgtattttgtctgctccctgcattcccatggttttgaccttatcttttacttttttttgtgaacataccaatgcttcaatttttttccagtaatataatcaactatactataagagaaaaatttcgataaaacacaaatttcatgttttcctactctaattggcttttacgtaaaaaatacaggtaaaatttatttgtgcttttttgctatttctgttttgctattttctgtttgtctatgtcttcaccacatagacacaattagggaattttgtacactcttgtgccaactgctttgacagtaacaaaatgtatttctcgaactcctaggtataaaactcaagtatccactatttaaattcttttttgctcacttctagtatgtttccagtctcaatagaaatcgatgccaatccagaaatacaagcattattctaatacttctcacacattactggtatggatgacattttctagatctccttaaatactatcatttttcactacttgtatcttaactgttaagttcaacattttctgtaatattaatatattgtgaaaatttcctttctttcttatttgtcccaggttcaatgttttgcagtctctacctcaccctgtgaagcataaacattgtacatgctgtacaaataatacatcgttcatgtacttagagattgcacaatttttatttggttgacaatagctaatgttttcttcttcattttctatttcctgatttttctttatttagtatatactacactgccataaaaataagaacgttttacaaactaaagcaaaaggaaccctaggaataaaatgcacaaataaaatatataaacatacgtttaggtgtaccacgtacacttgtaatttatttagacttttaattttagtacaattttaattaaagtctgtgtattatctgtcatcgtcttagtattttttatataacaaattgtgtaaatcaaaaagtatcaatgtcattgtaaactatcttggcagaggttgatctccaaggaataatttctctcctaaattatgccaatccaaatttcactctaccgtcattcttttcatcagtttcagaggaataataaatttcaaaattgttcaaggtacttcttttagttcaagtaacatttgacaggtgtaaaactgtagacagactgatacaaacgtattctaattgactcaaaattatatgggacctattttaaaatctagattttaaaatgtcgtgtcaacatacacatgttctccttgtgaaataattgttttttattctctggatagaataatttaatctttaaaccttccattcactcttagaaccaatatattacataaggatatgcttataaaaataattcccaactagcttttcagttcagaaatatatgtgaagaatcatcaaacatctaatggatttcaaggagaaatgggttagtaatttattccatatgtctcaatttttcctagactcaaggcttcctttaaaataattgtaggcatttaagaaaccatgcaaactaaaaagaagaaactgtgacgctgccgcttaggctttttaagtctttggacatgattcaatatattttttaaattgtatcttaattagacattgtgagttcaccatcttcctgtcaatacagcatccaagctgattatcatagattacaagttcaactatcaactgtgttctgagagtctaaaaaaataaatgaacgtatttgtttgggtattcttaaagcaggagtgaggacacagcgaaagtgagacaaggaaaagagaacaaaataaaacaggaaagacagaaaagccaataccacacgtgttaagaggtaagttcctgtgttagatatctgggcttaattttatgggaagctatgtggagcatgcctcagaattacatcactgaatccagggagattcttcttagttaccctcaccttttcttcccacttcatgcccagtaacaagctcccgtgctgctagagaaagtcctcagctagaaactggtgcaaattctggagatgagaccttgtagagtgttaagaatggttttcttcccagcagctacagctaaggaataggggctgggctatgaatacatctgctacaaaccaataaagcccttatgctccttttggtgatcgacaatgtatttaaaaatattagatgatcaagaagggctgcagaaaggaggaaacagaaacaaacagcacacctcttggtttattttttttcatttcatcagtttcaaggaaaatatgttgggagttcctggcatagagaatgtcacaaagacatgttttcaatagtagtgctatcccgagggcagagaagacccagagaaagcccaagtggctgctggaacaaaatcagacaccgtgccacctgtccacactccttggctctgccatcatgctgaagatcgctttaaaggactggcttccctccccccaaaattaaaagagcacagactgagaaactgaatgtgggagacagcagtggattatgctgttctcaggggtcacctcaggtttggaagcattctttcaaattaacccatctcaggccatctgcagagaagaaaggtggtacctaactttttttcttgtcggcatttggtaggggtgttttattgaccaaatatgttcccacaacctcgttttttgtgactaactaaatatagtagagttttaaattttatcatcaaaatctatagacaatttttgatgaaaatagactccatctctatgtcctgcttttcttcttcttattaattacattgctgtataaaagaacaagacttcagcatcaagaatatcttgtctcttggcattgaatttatacaaggtgctctttctttaatgctgtctcaaaggacatatttttactcattaaaaaggaagatcggaatctagttgtatgcactgctccaacatattaataattaaaattaggaggtaaatgtggtcaaagctatagaaagactgagatgtcatttacatcgattactctatagcactctacaaacagaaattgttaaataatagtttatataaatattttgtagcatttcaaatatttgagtgcttgaagtttctcctcttttatagttcagattatcaatttgaagacttactccgctagttaatatgtttttagtctcgtctgagtattatataaaagcaattttcagttaaatgtgttccgcttacataaaacgttacaaattattgaggatttaattacttattcatgttcctgtaatgtctttagaagattttcttattattacctatcaatatatgtatgctttgtcaaagaaaaatcaaacatatatatcaatgaaattgaaactttttaaaagtacttattaattctattgaaaaaccacatccataggaacaattacaatataatattgtgaacatgtaaacatataccctatgtctattttatgtataagcatgtatgattaaaaatatagtgaagaatttttaaacctagtattataaagtaaaaattagttaacttccgatgattatttgttaattaagataaaattattttgatttgggtgattttaaataaagaaaaatattaaattacatgacaaaaattctttataaaatgtttatgatttttacattggttttatcacttttcccactattttattttaagatgacctgccttgcttaaaacactgtattcatcttagttaaattagattccatttgtaaaataattaacaaatgatttgctctattgtacagtgcgtttataaactgagtcagtatctcaagatttgatccccattatcatcatctgtggccctatttgttttataaatgtattgtctttttccatgcctgtcacatctctattgctctttcatttttctctttgtcccttatagggagcattgcctatctctagattaagcaaaagttgcatcataaaaaagcacaataacctgctcaatctttctcacacagagaaatgtttgttaagtaattaaagtgtagatgatgatacaaagagcttgattaaattagatgccaaagtacccttgtgattcagaatatgaatggtatttaatttctttgaaatcattaattgctgagtgagattaattaatgccaatattccagaagatgttccagtcagtaaactgtatacaacgtgcaaaagattcagaactctgaagggcaacattattctataattaagaattaagaattaattcacattaattactggggagaaatactttttaagaattaatgactgagaaaatgtttttattttttatttagaaaattattttgtgcatgagcattaccgcaagttttgcaagaaacataaatttaaagaaacaattatgtgcacaagatgaatttaataacatcttgatatattccacgattgcggttttatttggtaaatctttcaaggcacaccatttaaagagaataaatgagtcttggaaatcttgtaggtaagggtaaatattaggatgcatccagttacatttacacacacatacagttacatttacacacacatacacgcatacagactgagtcacgtgtgtgtatatatatatatgaatttaccaattgatgttaactaatatttataagagacagttggattgatatatattgttgaacctgaaaaatatttattatatacatgtttaaaatacagaaataaatagcaattgcactaggcatttgaaactgtactaaaatataagctgtgaacattttgtgatcattacaaattcttacactgaataaatatttttatttttacaatattaatatgtttgatacctgtgtatatttttttacaatgtgttattttatttttgtcatagagtcatgtcatgcataataacattttagtcaaagatggattacatatacaaaagtggtcccatgagattataatagatatttttacatacttttctacgtttaattatgtttagatacataacctcttaccactgtgttcttattgcctgcagtattcagtacagtaatgtagtacacagatttgtagcctgggagaaagaggctataccatataaactaaacgtggtaggctgtacaatctaggtgtttgtaatactctctgtgatgtttgcaaaatggtaaaattgcctatgaatacatctgttaaaacgtatccctatcattcagtgatgtgtgactgtactaaaatgctcaatgtaagtttcaatgacctccataaaattgttgtactgtgaaatacaaatctctcacccatggcctgaatatgtttgcaaactaagcagatcatgggaaggagaatgtgctggcaccgctgggatgattttctcactctacatgaataatatctacagacttcgtgaatatgagccacttgcatagagttaaagtaggcatctctttgctgggaaaattatcaaatgggagtatgaagtgtttttacaagatactcatttgtttgtagctggtaggcctacagtggctcatggtaatggttgaggttgctaagatttggtggaagaaggcaaaatgaaatggccacttatatggtatatggtatatggatcacttatttctgttgagttacaaactcagctggctatttctcctatgttagttatttggagaaaaaaaaacgtgatggtaattttggggtaacaaatacaatatttgatgaaagcaaatttattgagggttagacaaactacaagatactttaggctacaaagtcaacacgagagttctggcccaaattgtgcagagtttgcgtccagctgcacagttcaaaggaagaggccatgtaagaagattctcacttctgacaccaactgccagttcaggggtttcccctgaacaccctcagtttcaagaatttactagaaagactcacagaactcattgaatgccattgtactcatggtttataatagagaaagggtagaaattaggaccaatagaagagacatatcatataaggtggaatctaggagattttgaaggttaagtttccattgtcttcaggacatattacctgtcattgttgtacagcaacaaacatggagtactaccaacctggggagctcacctgatgctaacaagacactatttacaaaatgaaaagacaaaggaaaagatgagataagatgacgttccacattaaggcactggaacgaatagcaaactaaacctaaagcaagcagaaggaagaaaattaaaattagagaaattaatattttataataataatatttgttagtgttgaataattgatattaattcttgactagcttttttaaaaaagagaaatattcactttccaatttattctgtggggccagtgttactttgatacaaaaattagtccaaatagcatagaaaaataaaactactataagtataaatgcaaaattccttaaaaaatactaacaaatcagatctagcaacatataaaagaattatacactatgacaaagtgaaatttatacaagtaatcccaggttggtttaacagcccaaaatccattaaggtgatacatcttatccatagaataagaaaagagaattcatgatcatctcgatagattcggaaaacacatttaacagaatccaaatgctttaatgattaaaaataaaaataaaaactcaatgaaccaggaatagagaactttctacaccagatacatggcacctgtgaaaagccaacagcaagcaggcaacttaatggtaaagaatgctttcccgctatggtcagagataagaataggatatatactttgacttcttctagtcaacactgtactaaagattttatgcagggcaaatcggcaactaaaataataagagtcatccatattgaacaggaagaaataaaactttatttgaaaataacattgttgtatatagaaaattttaaggaatccaccgaacgatagaactcgtaaattatttcagcaatattacagcagacaaggtaaatgtacaaaaatcaattgcacacatctgcaatgaaaaccccaaaatgaatttaagaaaacacttcaatttaaaatagcataaaaaaaagaaatattaattaatttggaaaatgtgatacaagattttactctcaaaattaaaaattattgtttaaagaatatttaaataattagtaaacaccttacacccatgaattggacgatttgatattgtagtactttacaatttgaactacagatttgatgaaatccctgcaagtatcccaacagacttgtgtctagaaactgacaagctgattctaaaatacacatgaaattgtaagggactcaaaatagccaaaataatcttgaagaaagaaaacatattaggataattcacaccccatgctccaaaccttactgcaaagtatcagtaatcaagacaacacaacattgatgaaggaaaaatatatagattgatggaagagaattgagagtccatatataaaactatgtgtctacagtcaatggattcttaaagtggtgccatgtgcaattcaatgaggaagagacagtctttgaacacactgggtcaacaacgtacacgtggatcaccacttgcaaaataataaattagaacccttaccccaaagcatacaaaaatattaactcaaatgaattaaagacacacatgcaagaggtagaataaagcatatgggaaaatcttcaggattttggatctagcaaagaaatagctgtaaccccaaaaacatgagcaacagaataaaaattagatatttaaaatttcttaaaaattaaagacatcggtgtttcagaggacaaccaagcaagtcaaaaggcagctccaaaattgtgagaagatatttgaaaaacacgtatctatatgtctgtatatatatatgtatcttgaatatagaaaaattggtttaactccgtcacaaatatcccaactcaaaactgataaatgataggaatagatgtgtttcccaagaagatacatgaacggtcaataatcccataaaaatatactcaacagcatcactcttcaggcaactacaaatcaaaaccacagttagatactctatggctagaactgaccactttggaaaataatttgatggcttctaaatatatgaaacatagaattgtcatatgacccagaaatttattcctaggtatacacccagattattggaaagaggtgttcaaacacaaattgtacacaagtatttttagcagcagtacctaaaatagccaaaggctgaacacaactcaaatgtcaataaaaatattattggataaacaaaatgttatatccatgaaattgaatgttatacagttataaaaagaaataaagtaccaatacgtacatgaaccttgatagcattatgccaactgaacgaagccgggcagaaaaggccacctattgtacgattctatttagatgaaaacagaataggaaaatctatagagacagaaaacagatttgtggttgcttaggattgagtaggggatgggtgcataggaggttaacagctagggaaggtggggtttctttttgaagtgatgaaaatgctctaaaattcattgtgatggtggctccacttatctgtgcatatactaaaagccactgacttgtagacattaatgtgtgcactctacactatgtaaattatatctcaataaatcctttcaaaaatacacagaagagtaaggggttttggaatgttgcaactgggatgcagtttgaaatactgaataggcctcatcgagaatgtgaagtttcagtaaagacctgaggaagttgaatgagctgatcaatggatatatggagggctatctttccaagccaaaaaattaactagagtcttgatcgtaaggcagcagcatgttggtatgtccagaggacagtgaggtggccaggaccactggtaagatcaagggtgaagatataaaataattttggcggttaacatgcggcagatgatgatgggcttgcagaccattgtaagaaatgttgtttttaatgtacatgaaatggggagacaactcattatcccattatcaatattttaataaattggatccatgaaccaaatccaatgagattaaatcaattaataataatatgcaaatttgtattaaaattacaagaattacttgcacatttgagaacaggagagacatgatttttatcagcaataataaacattattaattttaattgtgatcagctaattgagattaattgcaatacatcttgatttataatgtgactgtcaaaaggaaaatatgattgtaatcttatactacatctatcaatgtcttttattcataagagtatagagtaagcccctagttttcaaagccaacctatgaagcagtgacatcttatgcaagtttgctgctttctgccacagtgatccttggtcagtgggcacaaattgtttacaaaggcccctaggtctagaaatagtttggatcacaatgaacacagaaacaccttcatcccttcagaaatacccatcaattacttccaatacagaatgaaaaactgacaaaggaaatatgtggattgtaaaaatgccagttagcttgcaactacatgaaagaaaaatgccatttttattacattaggtcattgtctcacatgagttttggtatagcaaaatgttgaaccaagggaaaagagagatgaattaatgaagtcttaagatatcaagaatttgaaagaaaaggaaggtcatctttgaaggttagtgacatagcattcatcttcttttgtcacctttcccgtcattccctgtatgcctgacggacaggttacactcaagttcagagaacagcatgcaaaattagctaccaattaatctttaggaagtgagctgcatttctagccagactgagcttacgttttagcaggaagcatttttgggaaatgtttatgttagactttgcccttcttgacaaggtgagacataaacgtctactttatagacatgaattgagatgggaagatatttgggggaatcatttactcaaacgctaaataataaaggtacacaaagggcaaattatactagatttctttcccacttgttttctatgtctcatgcaattcaccttgattcccttcagtttctgtttaatgtagaaagtggcattttcattattttaagcttctagcacaatgaaagaatttctctttttcatgaacaggatcatacacgaaaaggaggaagagtgtcctatatcatatttattgttcaacaaaacactgctccacggcttaaattcagtttaaaaaagagaatttgttgaacatctaacacatacataaaaggcagtaaagacacatgagaagagggcaggatattgaagtatacagacttcaatgctgagttttatatcttaggaagttactccacctgacagaagctcaatttcccctgatttaggaaggcgatgctaatgggtattgcataggtgtaagtataaaaatgttgtatttaagagaatcccacaagcttggtataaggcagaaaataaatagatgtgacatgaataagtagtttattacatttgtatgctacctgcggactagaggaagcaagaaacacagccactatgcttgattagcattatagagatggtacgatgatggttgccagaagctggggggaggaggaaatggggaagtattgtttaatgggtatagagtttcagttttacaagatgaaacgaattatggagatggatggtagggacggctgcacaatgttatgactatatttagtaccactgaactgtacacttaaaatggttaacagagtacattttatgttatgtgtattttaccacaataaaaaaataaaataccttaggaacattttcatgaaaaagcccacataaaattcattttaatgcacgtgtttatgcatagctttctatttttctcttttctctttatattccaaattctaatcagagaagggaatcccctctgtacctccaggatattcagtaaagaccactggaggttcatgccctagtgacagtgctcatttagctccaaattacagatggctctagattaactcaacaaagtttaaagagaagatttaaaacaagacaaatactcatcctgaagttactgaactgcctgtcacaacattattcaaaggtagccaataaaatctagatattcaatagcataacatcaaaatacccaaaaaaaactctgaaatgcaaagaagctgtaagacatatataattaaaatatatattaacaggataaaaataagtcatttataaatgacagacaagaaggaaatttcaagatccttaaagtaaatatattttataaatacatatagataaatacatatatatgtcaaggtacttaaatgaaaattaaatataggagaaaaataaaagttataaaatgaaaaatgtgacatatatagatgaaaaataaatacttgaaataaaaattccatgagatagaataagtaatggattttaccctaacatcagaacatttatagaacaaattagaagcattacaaactaaaggacaaacggtaaactaaaataagaaaaccagaaactcactcataggtcagacaatgtgcatcagtgtaacatacatgtaatcaatatctcaaaaaggatgggtggggtaatcataggtgaataaggaatggtacactcattcctgagggcaccgaggagggaggatagctttagatttctaagggagagttttatccattcatgaaggtccaaccccatgaccaaacacctcccagtgagccccacctgcaacattggggatcaaattttaacatgagattggaaggggcaagcattcaaaccatagcaagagttaaatttcctttttaaaaaattcactgatatgattccatttcgccatagataaaaactagtatttcagcctaccattgagtgtgcttatagctcaccaaaagggcactcagtctcgggaatacagatttgcatagaggtatcctattgcagtcaaagaaagagcaatgagggatagaaaaggttagtgatggagacaccagcgctgcattttgcaacaaacaatgtaaaaactttatggattggttctgttaacttacttcagtttacattcctctcaggtgggagaatcgttgcgttttttcttaagatagaaaagcaattcaggtaatctgaaatctccacaagaaggataagaagcacagcagaaactattctaggcaggaagtcaatcctttcaactgtctgtgctccatagaaaccattgtctgcactgggagtcatatgaggtacagacaacagccagacctctgatcctctcattagtgatttcagaagaaattaccagtcaactgagtaactcactgagtatagtaaacatttggcactgaaagaggttagatgaataactatttgtatcaccatattcatgaagctgaaatatgttccattactggtatcacatccgaatggaagatattaaaaggtctctcatcttgtaagatagatatgaaagaatattttctgagaaatgaaattattaacacacctgcgaggtgcatggaagagaaaaaaaagaataatcaccttgagatcttctccttgataagagaactcactaaaaacataaagagaaaaatacaagtttaaaataattaaccagaagaagatgactctagagattttaaattgctgataagattttaatttgctccaagttgaaaataattatattgcttgtgttttaaggcacataatgagcaattatatcacacatgatagtttcagcagtaaaatagtatccgttaacagctggaactcataaaagcatagcacaatgtgaagatggaatttgctaaaataaaccatctgctgaaaactgctattctgcaaatttaaaaataaagtttaaatgttatttgtcttatttaataggtctgtgaaaaaaatgcgctatttggaaagcagctgctaccttaattaattctttatattagacggctggttacaataatgtacagtaaggtgctacatagatatattgctaaattttctgcatatactatgtatttggcttaaattaattgaaattttattgttaaaataacaaatgtacatttcaatgttttgacacaaattgcaaatatacctttaaaaagcgtcttacactctaaatattatttgtcacctatatatttgtcttttctctataggaaaatttaaatttttcccttgaagctttaattatttgagtctataaaacaaactgataatgtacaaattaacaggaaaaaaaggtttacagatatgtgcacaagtatgcacttggagtttacataatatatataaatatatctatacaaatatttgtatattataaagagatatacaaatatatactctttatataaaaactccaggaaaggcaaggtagtcaacatgcctatgctgtcttgaggttgcagaaaacacagagctgtaggttggtaaatcaggctttgtggaagacaggtgacgacaaggaagaaagaggagcctggcagcagaggtggtcttgttacatggatgaaacctcacagggagcagccctcctcttgggaagtatagataggaaatggcttttagaaatgtaaacgtgccaggctcagttaatcattcctatacccagacaagggagtatctcagggaaagcctgtctatatcaatgcagattttctctacaaatgcaaatctccccaacaaacacagcttttcagctattcttgtagaagaagctatctccagtcttccgagtagccatcgtgaaatatgtcaaaaagctggccaggcgcatgcctgtaataacagcactttgggaggctgaagtgggtagatcacctgaagtcaggagttggagaccagcctgaccaacatggtgaaacgccgtctctactaaatacaaaaaattagccgagtgtggtggtgcatgcctgtaatctcagctacttgggaggccgagctaggagaattacctgaccctgggaggctgaagttgcagtgagccaagattgtgtcattgcactctagcctgggcagtaaaaacaaaactccatctcaaaaaaataatgtattttagggtaatattttgagtatctttacctccatatgtacaataaaaattattgcgatttttaatcttttctgtggagaaaacacaggtgtgatttctagtgtagctgaacatcgtttatttgacagtattgcacttgtgtgtgggtgtgtgcgtgtgtagctactttttaatttggttcttacaaaatgattagatactaacaattaattcagtaaaatgtatgttttgcaatatttctccatgttattatgctttaaattagtttaatcatgcccctataatgtgtacattttaacctttgactatagctctcaatcttactttggttcctgtatttgaatttatgctaataaagtcccacagcttaataagattacataaattttttgtataatttttactagcattctggtgtcattttaaattatgtaatgaaatccaattttaatttggattattgttatctgagttaaggatataaatttttaattttcttataaatattacataattatttctgaaccatacattgactaatctgccctttatatgatgtgtattataagagcttgggatcgtttcatttgcaaagatgaatgcttgagaagtagatatttaatcataacatttcaaaatctactggataacctagaattgaaacatagcctataggttgaaaaactcctgtagtgaagaaagaaaataactaatatacagtgacaatataaatattataagtatttattttattatcaccctgaaatttgataatacaaacatgtaatatctacatatcatccatatatcaggtcataaaatatcaatacattcttcaaaaatttagcataacagaaaatgcactctctctccttgatggaattaagttacaaataaaagtaaaaataagtagataagtagatggaagtagatgtttaaaaacaaagaaaaatatttgttttggataacataaaatctcaattgacaattccaatatttccagaactttgcctgtcaactggtggagagttttccccaggagacatttgtcaatgtctagggttatcgtggggatgtcaagactggtggaggtgtgaaatttagaggtcacaagaaacacctagcattgctagggcagcctcccacaacaaagaatcctctggtcctaaaggtaagtagcaccaaggttgagaaaccataatctagacaggaaacactacgtagctattccaagtgctcaggaaaacacatcagtgccctcgaggggaaaagtgtaaacattttaattgctgtacatggtgacacaaatccatgttgttaatctaagtggaaggggctgaagcacaaaacgtaattcaaagagtttacttaagccacagtgaggacagctgcctggaagaaacagacccaagtatccttggatgtgaactccctttggagctttgcaacaagcagtttcttaaaggtaaaaaagggtccagaagtgggatgatgcaaagaggtttgtcacaaattctcattggcttatggaaataacatttattagtgactggctatacacggttacactattatggggtgtggattatagtgtctggtgtggcgttattggttaattcatagctactgtggcaacagcaagcagcctagatgaacacacagctcaaagaggagcaggacagaactgctgtgtcatttgaatatctctctgggcctgattatttcaaaggacttgcatttctcacatgaaagttattttcttttctccatgtccataaatgagaataaatagacgtaaaatagatcttttcgaggatgaagtaattggaatgaaaaacaaaacccaagctgaccggaaatcattgagggaaaaaaaggatataaatatatgtatttttcaaagtgattttaagctattaggaatcagttaaatgttgggggaatttgtctgataatgggctaaaggagaatgtcccttttgccttctgaagtctccctgaaaatcactaataggaggcagataaatagtagaaaaggcatacaggtttctgcaatgtgtgtacactggaacccttagaacgaagacccagtcacacgatgcgtgcagaagcttatctaccacatgaagtttacagaaaaatggggtcttggatcacagggaaaagaaagaaaaaggttatgtgagaaaacgaccctggctagcaacagtggacttattacataggtggaatctcactgggagtagtcctcagagagaatagacagaaaatgtttctttcagacatttggagacctcagcctctcagttaacctttcctagatccagacaagggggcagacctcagagaaaacctggctgcatcagggcagattctctaccgatgcaaatctccccaagacagctttgcagctaacattgcatttccagcccttctcaatagccattttgaaatatatcaaggaaatatatttaggggtaaaatatgttagtttccttcatacagctataaaacatacaggaataatttttgtcaatgtctactacaaatccaatatagcagtaactatgacacccaccagatattgatgaaaaaatatgtagagtacctcaattacaaatgttgatactaaaatgccaaataaaatacaaataatatccaacaatatttgaaacaattagacaagaaattggcaaaaaaaaaaaaaaatccaccttcgggatgaaagtgtgtttccaaatttggtaatccagtaatattaataatcatattgattagcccaaattaaaaataaataggggattctcagtacatgctataatatatttgttaaaaggcaatattcatgtctttaaagattttaaatgctataaagagtctgatattctatatgcaaacatgtgtatgtccattagaagaagagaggcctgattttcatatgttactacatagagatagagaagtggatacattaatttgcatatgcatagagaaagcataacatagaaattgactatcatattaaaggaattttaattcaacaataaaataattcaaaggtaaaattttagatatttttaacaggtacattattagtattagataatatttataataattgtgaaaatactcagcgctaaaataagatacaatgtctaaacatcagtaataatactagtataaatatttgcttgtttatacaaggaaaattcaagctcgacctaaaattataagggaaataaaagaaaaatattaagggagctctttcacgacataaacgtatatatataaacacacacatataacatgtatatatgttatatgggatagatatagatttagcaggttatatctatatttgtatctgtaactacagctgtatgtatccacatttctacatatttactcagtgatataaatatagactggaataaatataaagacatatatgattcttggataaaaaggatttagtatcataaagacaaattctttccaaattcacttatgaattcacaacaatatacagtttcattagtataatttaatatttctaaataaatttcaagattcatttaaaggaatataaatgtatacaagcagtcaagaaagaagcaagagggcactaaactaacttgctgttaaaatacatttttaaacttagtcactaaaaccgagcagtactgatttggagtactggaatttaggtgtatgggatctcaaaagcacagagctcaaaggagacccctgtatgcacgagagcttaggatgtgctttagaaggcattaccaaaccacgggcaaagttaccttagtgtcttagtcttactaggtttgaaaagccagagaaaagactcaagaccaccatataagagcaaaacaaaaggacagggagagaatgtgaagatactgaaacattttacataaagttgtataaaacatattttaaagaaaatataaagttttggatatacatcaaaatcagcagagccactaaataaataaataggcattgtaaaataacaagagaaaatttaaacggatttctaaaaacattgacacctatgatttttaaaatatgtttaagaaatcccatatttcacagggcagcctttcacaacacagatatgttaggacataaaggtccttctgtttttaatttactagtgtttatagggttacaaatgtcttctacccttgtcttttgtctgatggtgcaaaaatttttcataagcatgtatttctgaatgcctgatggattgacatatataatatgttgctagtattaaaatatgagatggaaaacgcatccaatcttctcactgtttacagaaattctaggtttctcctatttacctcaagcacatatggagcgaattcttaccttttaatattgccatggcattcacattgaacataagttgaactctctcatatggtagctgggttcggattctcttgacaatttccagttctaaccctcacacttcctcagtgtggttggcccagatattgaccctacacagttatctcctcgtggtgactaccagctatggaaccgttggatacaacctacctgactcaccccacagacctcacagcgcacatggacagcccccacacgccacagtaacctgctcgcttgcagtgggagtcaagaaatgtgcctgctggcactcaccccaccgactagtgccccgtggaaaacttatttgggtaatgttctgggccaaataatggctggagtcccacagaccccttttctctctcctgctccccactcatcttccccattttgtttagccctatgaggtgtgctactgtattagtccattttcacaccgccggtaaagacatgcccaagactgggtaatttccagaagaaagaggtttaatagacgaacagttccacatggctgggtaggcctcacaatcatggtgcaagctgaaaggcacgtctcacatggcagcagacaagacaagagagcttgtgcagggaaactcccctttataaaaccatcagatcttgtgagacttattcactatcagaagaacagcatgggaaagacctgcccccatgattcaattacctcccacctgttccctcccacaacatgtgggaattcaagatgagatttggctggggacacagctaaaccctcttctcagctaccctcttctctctggatctgtgagtaataaacctacttctgtgatttcccatgtttggttctgtggcctccatgtgtctgagctgacctacactagaacctaactctcctcctggccagggtctctgagagtggctcttgtcagaaatacacaggacacaggtcaggcaacagtcaccaggcatctcctagtctcaacagatgttctgtgagagggaggcctggtcgtgggatgcacacctggccaccgctggggtaaggaagtgtcctgtgaaaggcacatgttaagcatccacaaccccctgaccagaaccccagaaaggcagggatccaattgacagtcactctccagagacaaacctgaagccctaactggaggaaaagacaacaatgtaaaaagttgaatttatcttactatttcaatgatccagtaaagacattctatgcctgtacaccacatattttcttcgattgtggatttattttagatagaattttaggtctggctttcactttagcctggtccctacctcaagcataaggtaaagattttccatgggttcttttctggtactactacctgccagtgtggggtcatgtcctagtctatcttgagggaatccccctgttcattattgtcagagtgagactgttaagtcttgatttccctgtacaacttcactgcgtgacttttaatatgattttttaatataccctttactggacaataaattctatagttatctgagtaagagatatgctcaggaagaggcattgcctcattcagcttttctctttggtgaactcgcatatgttctcctcacccgccagtcacccctaaaccgtattgttccaagacaacaaacagaactcgagtgtttatctttcaccactggatttgtgtttgctccataaagcttcatgcttaacagagtttctgttagcattttctctatttattttcccataaaatatcacaggccttcttcttatggaattatgggtgatttccttcaatctgcatcatatcaagttgaggttcatgttgatgaaaagtaaaacatacgttgaaaatatcagtaaggatgttttcccctcctttttagcacctgtgcttgtgatacaagcacattttaatacaattgtagtctcatgctttgatcattcctatgatgaaaataacatttttagataaaatatctgagttttatgagggctttagtatgtgatgtgatagaatatcagaagaccatacttttttctagttgtccgtgcaattctatcattgtttcatctttactcctaccagagtaattttccaaaatagatatcttgtcattcttcctgttgttatcagtaaataagtgaaatgaaaagctagattatataatttatctagaacaagaaagtagaattgaatctatattcattaatgagactaactagtcaattacacagacaggcattttacattttgaagatcatatggacccattgtcagaaatattattatttatgtctatatggacatcacctgtgcatatttacatagaaatcaatgatagttgatgtttatttttattatatatattttttgagatggggtcttgctttgttgcctaggctggagtgtagtggtgcaatcactgctcactgcagcttcagcctcccaagctcaagcaatccttccaccttggcctcccaaatggctaggacaacaggtgcacatcaccttgcccacttttttttttttaacttttgatagagactgggtcttgctatgttgctcaggttgcttgtgaactccagggctcaaggaatcctctcatgtcaggctcttcaactgctggtattacaagcatgaaccaccatatgggctggaagctgatttttaaaatactgagatcatatagatgacagcatctgaaaaatagacaacaccaagttttacgttaaaaggtgtgagggtagcaatatggttgtggctattggggaggaaaccattagtaaaaccagtaagttaaagctcttgctttaaactttggctataatttaacaaatgttctatggagtgacagtatgtatgtaaccatgctatacccattcacagatgcagtagagggaagaatttctcaaagacaactgttctaagactcaaattaaaccgtcctgggtttgaaaagagaaagtccaggaattaccaaatattttagatatcagatacaagagaatgccaggtatgcgatgataatcagcaatggttgttcacacaatacatcaaatcagtatttgaattagcttctgaattacaaggacaaatggatcaagtctagactctttagtagagaaatcttatcaggctgagatgtgttttcccctgtttttccacaaggagattactaatttggaaacctcagctgctcttattttatgctctcaccaagccaaaagctgaagttcatcaatcagtgtgtctaagtgttcactggttatataccattttgtagtttcagctatctttccaacttcctaaatcatcaccttcatttgatcttgtttttttccactatcacttctttattgaccatataaagaatataagtaagttcttattttgttattgttcattttagtctaatttcatcaaaagatcacaatcttttaatttcattttaatttcaaagattaaatgaaacctacatagaaatgagtgtaagatttgcatttgcattattttggcatcaatttgctatcctccctcatgcacatagagatcatttccatgtatgtgatttcaaacatccaagggcagtattaaaagcagttgtaaattatggttctcattttcgtgatacaattacaatataaacttcctcttgctgctgtaaccaattaccacaaacttcatatattacaataaagtgaccgttaatcccacagttctgtagtacagaagccttaaatgaaactcgcagggctaacatcaagttttgggtagggctgcagtctttctgagggctatgtggcataatctattacttgatatttttcagcatccagaggccacctttattctttggaacatgacctcattcttatatcctatttttcttttttttttttcagatggagtctccttctgtcaccaaggctgtagtgcagtggcacgatctcagctcactgcaacctctgcctcccgggttcaagtgattcttctgactcagcttcctgagtagcttggactacagacacttgccaccacacccagttaattttttgtatttttagtagggatggggtttcaccatgttagccaggatggtctcgatctcctgacctcgtgataaacccaccctagcctcccaaagtgctgggattaggcgtgagccaccccactgggtcctcattcttgtatcttaaaagtcagtgatgttgagtaatttctcatgccaccacctccaaggttgcctttcttctgccttcttctttcacttaaaaggaagtttgtgatttcattgatcccacccatttaagacaatctctctatcatttttctgcaaccttaatttcacttgaaatctaatttcacactgccgtgcaacctaacatatttgtatgttagactctgggaattaggacatgaaaatttttgggaggccattctttggcctacagcagacataatctatttacctgcagattaaagctttctatatgtttctgactccctctcttaattttctaaaataatattaattgcagtaaagagaaagaaagaaaagaaaacaaagaaagaaaaagatggaaggaaagaaggaaggaaggaataaagaaagaaagagaaaagaaggaggaaatgagggaaggatgggagggagggaggaagggagaaaggcaggaagggagaaaacagaaaacatgaacacaagaaagaaagaaagaaagaaagaaagaaagaaagaaagaaagaaagaaagaaaggaagggaggaaggaaaggaggaagagagaatggtaaaagggaggaaggcaaagaaacaaagaaaataaacaggcgaaggaaggaaagaaaaagaggaaaggaagggagggaggaaggaagaaaaaaggaaagaaagcaagaacgtgagaaagaaagaaagaatatgagaaaagaaggaagaaaagggagggagaaaggaagggagggattagggaaggaagaataagaggaaagaaacaaagaaggaaagaaggaaggaaggagaaaaaaagaaggaaaagaaagaaaggaaaagaaaaaagaaaaggaagaggaaaagaagaaaggaaggaagaaggcaagtgaagggaagagaagagaaaggaagatggaaagaagtaaggaagaacgcaaatgttataaattctgggtttgttagagaatatgccatattgtttttttttcactagaaaggaaagattatctgccattgaagattggatgtcttgttggtgatattgttgttcttaacttccacatgattattgagtttgtgccttgtctttccattactaagacaaaagtgttgaagtctgcaaatataattttgattttttctagttcacctttgatttctttcttgttttacctcatgtatttggaggttctgttgttagctgcataccctaattagtaggatgtttacatcttcttgtatgtaattgatgattctattatgtattatctctcatctctgatactatttcttgttccgaactctgttgtggctaatatcgatgtagtccttccacagccttattttagtgtttccatgatatggctttctccatatcttgatgataacctatttatatctctatatatttggagcaagatataaaatttagacctgactttttaaagatttttcaagatgtaattcttatttctttttgttctatttgacattctctgagtttcctatatttgaagtttgattttctgtcacttcttttacaatatttttggcagttattttgaaaaatatttcttttgctccattatttttccctcttttctttttgggatttcaatcataactagagtaggtaatttgatctcagtcttatgcaggtactttttctcagggtctcaggaatgtaaccttctcacacttctgttcttttcctggctgtgttggtgagctcagtgatattcctccttcaccttctagagcaggtttgttttgtttttcttgttttcatactcccagcatcaggagtattctaagtgtggcagtttttgttgccttcccctacatattaagtggaatatcttgctctatttggactcttataacaaaataacataaactgagtgactaaaaagcaacagatttttttttcacacttcttgaggctgtaagatctcaggtcaagatgctcacaaattcagtgttgatgagagcccatttcatggttcatagatagtgccttctttctatgtcctcacgtagtggaaggcacacaagaactccattgagcttcttttataaagacactaatcccattcatatgggctcgacccccaagacctggtcacctccgaagtgttctgctctccctgatctgtgtcatatacagactctcttgaattccttaccaattgcttgagagatcgcattgagtttgtggggaaaatgttttcaagatggtggatctttcccaacttctgcagctgtcagcggtctcccaatctcaccagccccactttgtctttaggaatttattgattattccagctttacttgtcatagtggtgtctatacgcatctgtcctatgtaagtgcgtctgtcctttttctccttgcaggtgcaagtactcaggagtacactgttgttactaattactcagtattggttggtacattgtcaaagaccaaagaacatttttaaagataaaaaaaagtcttggaggttgtgtaatgaagggttaattctgcagacatggctttccaaaatcttgtgcattccaaaggtcttcaggactggcccttgacaagctcctgggagatgttaacctatgagcccttggtatatgttgcctgatgtgagtctttgcatacatgaaaacgtaggtcatatcaaatagctgatgctaacaacgtgatttcttgtgagcacctgtttctgtatgcctatgactttgtgtaatgccatattaatatgacctctcttaacgcatagggaggttgggaactgagtagctatgttcagtcacaggacgctcgatgcatatgtggcggaatcctaataaaaaccctggactcaagactgactgagcttccctagttggtaataagttcacacatgtctcacaccattgtaaagaaaattagtcagtgtgaagtccccactatgaaaggacacctgtaagctcacatctggtttgtcctggactcaactttatgtgcttttatgcttctgattattttaatctggtttctttcactgttagaaactataaccacaaaaaaaaatcagctttcttgggttatgtgaatcattaagccaaagggggacttggggacccccaataaaatgtatatatattcttaaaaagaaaaagtaaactggctatagcagatattgctgatgacttgtcttctatgtcctggactcaatgtgttcatctgaaattcacctgattccagctaactgagagctccccacatcatgcctgtctttctgatttttgggcctgcctgcaagcttcttgaggctaaccagtgcttctcaaccacacgtaggaacaaagaaggagttaggggtggagagttaatgattctaaggcaatccttaagcaataagagatggggattccagcatccccatctctttgtaaagttattttgacacaatctccatacctccatcattactgagcacacagtagtaactactcattgacactggcttcgtgttctgtttcattttctccacttctgtgctttctcactcaatttctgattaaagtatctgaccccagatatttgtttcatagtctatttttgagggaatccagagccaagacaataacaatgggagctttgcaatgagggagggtgagtataatcatcagaaggttacctacctcactgggaacatggaggcctggagagcttgctgtttcaatgagagaaacatgttgaatctcagttcaatacatatatatatatgtgcaataagacgtgccctttatttatatcaaaggaaagtgctctttacctctctttgttgttgtgtttttatcactattgcctacacaagcagaatatcatacccaggatttaaagccctctctgcaggattttcaagctcatgtttttatcataagtcactctgcttccatgtgttttcaatctaatcctcattcctctgcttttacaccagagaattcatcactgacttatttttgactgacctccttatagagctgtcaagtacacaatttctgctgtgacctttctcttagagttcagtcatatagcctctcactagatatcatttcctcttatctttcctaataatgaattgtcagttaaaactcaacatttttaagattgagcttaccatctgcacacacacacacacaccattattggtgtattctcatagccttgaaacactaatgtcaccttgatgtctgccttttctctctctgctacctcattcctcatccttagattgttctaaaagattcaattagatcaaattggctaattatatttttaagatcctctctacccttcccaacatttcgtttaacaaaatttaaaaatttctggcaggagactgttgaaatccccatggatgactatggttttactattttacctttcagttttaataggttttatattaagtattttgaagtaatgctattgtgtgcatacatatttcttatttacatgacttcttggtgtattttcccctttttcattttgaaatgttattcttcatccccagtgatatttcctgttctgatgtctactttcctcatcacagttttagggagttttggtttgtttgtttttctattgtttggttcaagtaagtttcttataaatctcttcgattccattcaatgattccatttgtttccattcgaagattccactcgattccattcgatgatgattccattcgagtccattcaatgattccattcgagtccattcgatgacgattccattagagtccattcgatgattcaattcgattccatttgattccatttgatgatgattccattagagtccattcgatgattccattcgagtccatttgatgattccatccgattccattcaatgatgacacaattcaagtcccttcattgattccattcaattccattgtatgatgactgcattcggttccatacgatgatgattccaacggattccattcaatttctccattcgattccattccttgctgattccattcaattccattagatgataactccactagattcctttcaatgttgatttcattagattctattcgatgatgatccaatttgattctgttcaatgatgattctatttgattccgttcaataatttcattcaattccattcgaagattccattcgtttccattcgatggtgattccattcctgtccaatcgtttattccattcgattccattcgatgatgattacatgtgagtccattcgatgattccatttgattccatgcgatgatgattccattgagtccattcgatgatttcatttgattccattagatgaggactgcaatcggttccattcgatgatgattctaacggactccatttgaagactccattcgattccattcattgatgattctatttgattccatttgatgatgattcctttcgattctattcgatgattattccattcgattccattcgatgatgatttcattcgagtccattcggtgattccatttgattccattcaatgatgattccattcaagtccattcgaggattgtattcgaatccatctgatgattgcttttgattatattcgacgatgattccactcgagtctattcgatgattccattcgattccattcgatgatgattccattcgagtccatttgatgattccatttgattctattctccgatgattacattcgagtacattcgatgattccacttgattccatacaatgatgatttcgttcaattccattcgatgattccattctattccattcaatgatgattccattcaggtcaattagatgattccattcgattccattcgatgattattccattcgagtccattcgatgatcccatttgattccattttatgatgattccatttgggtacaatagatgattccattcgatgatgtttctattgcagtccactagatgattccattcgattccatttgattatgattccattcgagtccattcagtgattccattcgattccatttgatgatgattccatttgattccattcgatgatgatttcactcgagtccatttgatgattccatttgattccgttagatgatgattccattcaattccattcaatgattctattctaatccatttgatgattgcttttgattatattcgatgatgattccactcgagcccattcgatgattccattcgatgatgattccattcgagtccatttgatgattccatttgattccattctccgatgattaagttcgagtccattcgatgattccacttgattccatacaatgatgattccgttcaattccattcaatgattccattctattccattcaatgataattccattcgagtacattagatgattccattcgattccattcgatgatgattctattcttccccattagatgattccacacgattccattcgatgatgattctatttgagtccattcgatgattccattcgattccatttgatgatgaccccattccattccattcattggtgattccattcaattccattcattgattccattacattccattcaacaatgattccattcgattccattcgatgattacacttgattccacttgacgatgactccacttgattccattcgatgattccatttgattctatttgatgataattccattcgattccattcgatgaggattgcattcaattacattcaaagattccattcgattccatttgatgatgattccattcgattccatttgatgattccatttgattccatttgaggattccactctattccattcgatgatcattccattcgagtccattcaatgattccattccagtccatttgatgattccatttgattccattcgatgatgattccatttcattccattcaatgattccattcgattccattcgatgattccatatgagtcctttcgattattccagtcgagtccattcgatgatcccatttgataccattcgatgataattccattggagtccatttgatgatgattccattcgattcaattgcataattccgttcgattccattcgatgattccctcagaatcctttcgatgatgattccattcgattccattcgatgatgattccatttaattccattcgatgttgattccattcgattccattcgatgatgattcctttcgattccattcaatgatgattccattctattccattcgatgattccactcaattgcattcgatgatgattccatttgtgtccattcgatgacacaatatataattaattaattaatatatataaaatatgtccctagataaatcataacagttgaagaacagaggcatggtaaatttttttgctgttgttttgttttgttttgttttgttttgttttgatacagagtctcactctgtcacccaggctggagtgcagtggcgccatctcagctcactacaaattctacctcccaggttcaagcaattctcccgcctcagcctccccagtagctgggattacaggcatgctccaccatgcccagctaatttttgtgtgtttttagtagaggaggggtttcaccatattggccaggctggtctcgaactcctgaccttgagatctgcctgcctcggcctctcaaagtgctgggattacaggcgtgagccaccacacctggcccatactaagttttttaatgcaatactttatcaaggtagaatttactcttaaatacctcctatggcttatgtgccagaattcagcttgggggagttccttagagatgttctcatagaaatctctacagaagcccccataactccataacttagcatccattctttccatacttactctttcctcttctgtcctgcattaggaaatatgattccctgattcaggatcaggcctgggaactgtctcacctatggcaaaaaatatgagaagggagaggtatttgttatcttatcacctggcatgcaaaagatacagtaaaatcttctgaggatctcctaaggagcaatgacattgactactacttgggacagagcttctgggagcaactcgcccagggaagccagctgacagagaggctcaccagcaaactcagcaccagtaagttggccacagggctttggaatactctcagtcacccccatagttccagcccctggtggccaccacatctccactgtaactttttaacctaggatcctgtttctatttcatttcctggggctaatatagaatgaagactgctcagtggggagcatggagaggaacacacagggctggagatgccatggttacaactatagaaacttcaccactcatggaatgtgacctgtggggcaggggcagcatctatctgatgctaagagggagtaggggacatgagatggaagggccttgttataggaggaagagccccgagctaagaattgcaagacccaagctctagcctggatgctgccaccaacttgctaaatgccttatccttgtggtgcctccatttatggcatggcaatgtacgtgaaggtactccatatatggataaagcgccatgctcttttatacatggtttaggcactggctgcagtagttcaagggctacattggttattattggggtcctctactcagaatttccagagaatatccaaaggagtaaagtaggatcagacttgggagccacctagcccacctcctggtggcagatgcagaggtggggcagggcttcttgtcatctcctcagagaccagtgcaggttctgcatgaaatctgtggtgggacatatgcattggggagctagtttgcaccaggactcggaggctggagtgtcccacagggcatctgggcaagggcctcatggttaatggaacaaaagacattttaaatgttttaccctgatttagggcagaggaagtcatgatggtgaccagcaggtcagggacagtgaggtcacttctctagagacacaagctgaggtctcccagaataactgttctggatgcacacatgaaatgctcactactctgtctccagataggctcctgcatttgtaatgtgggaagtgggaccagcctaatttcttattgtttctttctaaatttggtttgctgaggatcataaaagtgagaaagatcaagctggacttgagccactggtcctcaggtaattcagaggggaatctgggaaagagattgggactaaggcccaaagggtcaagggtggcggcaactccacaaatcaaggggaataaaggaaagtgctaaatgtattgaattcatgcattcattgaacacctcactgttgtttttaactaaattattccttcccttttggtttaatcacattggcacattaattctccaggcttagtaacctagaaacagtctgagctaaaagtgaactaactaggtttcaagagtcttctgccccactaagggtcacgctttcctgctgtgtgtttaataagtagaatgagctttttgcaaagttggcctgccccaagttgggttgacagctagtttaatagtcactcaattgccctgggggaaaaaaggaatcatataacaggacctggtgaaagaggcctagatggtgtagatcacaagaaggctgcagtgcctcaggacccagttctcagtgagttgcttcatataatgatcaatgaaatatgggctcagagtccattgtagccactagttggggttctttgtgtcatgcttgtgtctcagactacataaatgcttctgaaaatatctgtagtgaaggacacagtgttgttttttgttttgttttgtttttatttctaatccatcatagaaacatacatggtctgaattcacttaactatatgattccatttatcatgctcttggatgctggaacaatggtttgctctgcgtttctcaatgcttgctttcaatttttataattgtcttgttggagatggtaacaaacagttcgcaggctgcaactgttccagggatcatacattaagcagcagtgccttaaaaggagggctagctatgtctttgcttgtcttcggcatattatgtggccagagcactgggtagctattctttctccatctacaccccacctacgctccatccctaagcagaggtgggttatttctattattctctgcaggcatggtccccttggcttacttggcttttcctatgagccacagtcaggacaggttggtttgggcgaccctggttttacctgttgtcccccttctccccaccaggctcagcagggagctgcaggagaaggagaaagtgattgaagtcctgcaggccaaggtggatgctcggtccctcacaccctccagcagccatgctttgtctgactcccactgctttcccagcagcacctttttcctgtctgatgagctggaagcctgctctgacatggacatagccagcgagtacacacactatgaagagaagaaagcttctcctgctcactcaggtagcctccactttctgggtggtaccatctttgtctagactgagtggagaactcaggaaacaggacttatagctccatcatggtgtgtatcaggctgaacatggctgtggggccaagtgtcatgcacaagcaccagtggatcaggatctttgctctaatcctgactctacaagttacccctgtcaccctggcctccatgggcttgtacatgctgttgggcacaaggtgagccattgtggggagagtgagaagatcacagccgactcttcttcctcggcgactctgtcagacagatcttctttaagatggaaaacctccttcacctctcctacaatgatcttgctacttattcctgagcagtgttccctaaacatatgtgggtgtacacaaatgctgctagtcttgcctgataattttggagttgtcgttttcatgttccagagctcagagcaccactgtcgtccctaaggtggtttacctcactatagggtctgtctgcaagaaagaaaatgaacactgctaacagtgcttgtgcttggttctttccctgaaagcaagactctagccctggtacccctggctaaatataaggccaggattccagttctctgtagaacatcaaacgttttctttcattcatgggttttatagattccatccatcatttgagtcattctgctgtattgtcttctaaaccgtcatcaaccagtgcatctctgggggctaaggccaaatccagcagcaaccccatcagcttgccaactccccagaatccccccaaggaggccgaccaggcccattcaggtatgcaacagccaatggggcagaagcttcatctcctctttgatttttcttcaaggacagaggtttggactgttaggggcgtaaattcatcaaaacctagacagaatcaagaaaccaccctcattcaccaattgtgtctgatttaagaaaatattttagaaaataagtaatccacatcaggttttgatccgcacaccagctttgaccagtagttggctgaccatttaaaaagaaacatttttattggttttctctcattttatcctgggaggaaagaggaaaaatgtttctcccaggattacaacagccataggatgaaaagaaattcacatctactgatccactgtatgtgttacccattaaatctgcatggagatcctccccaagagacagtgctacttatttcatagccaaggacgctgagaacagcctcagacaaggttctgttcatagtacattaccattaatggatgtatgaatggattggcagtccttgatatgtacgtagtgcatatcttgggggcagttaaaagggtgcatttcatttacaagtccagcttagttgccagagggtacactgctcattcacagccctgtaccaggggtggcaaggaaaaggcaaaccttgtcttcacctcctacctcccaccatagctggctggctgccttcagtatggtttgttgtgaggtttgacttgagtagaggtgctcccagaaagcacagtgctttcttctgctgccctcatttccctgaaggcaattcaaccaaaatcttaaagaagaggaagtgttccaatgcttcctgagcctggtttcaaagtttctaggccagagtgggcagcagctggaccagaatcatgaagtaaagctttgcttccagaattgtagacatctgcttaaatgttttgggttcaaacagagcagaagatgaagaatggaggatttaaaaatcagaatgcctcctcaaagaatgtctgggctgtgttacctggcaatttgagtgtatttgcagttttgatctgaaatggtgtcagcactgttgggttgtgttttaggacgtaatcattgtcttctacattagacattctctatgggtcagccttggtttctgccccccaccattggctacctgccctttaattgcttttagggaagaggaaacaattttaaacattgaaacttgacagggcttctaaagatctatctgacagagtaaccaaggaagaagagtctgctgtgatcttctcactctccccacaatggctcaccttgtgccccacagcatgtacatgcccatggaggccagggtgacagaggtaacttgtagagtcaggagcagagcaaagatcctgatccactggtgcttgtgcatggcacttggacccacaaggtctctaaaaacttgtctgtaggtgggctgcctaaagatcaccagggaagactttttttaatacaaatttcctgttccaagaatttataattctgtaagtctacattaatgcctagacagaatcaagaaggcctaaagaatctacatatattaagagtttttgctatgtgatttaaatgcccagaagggtttgcaagccattttgtctaagccactctaccaaggcatctatttttaatttggtgattgaacacgttgatttggaattctgaagtttgtttccatcagagtcctcaactgcatgcactagtaatgaaaatttccccacagcctttgttcatctctctcctactcaggatgggacctgatgccatcagagaggagttctaggtggagaaagagtcttgtcccaaggccaaggactgatacatgctgggagcagagccccaggggcccttgagagcattcaggctctctgacttttccatgcccaggattgctggcgtggggctcaataatgccaccttaccttgtttagccaattgctttcaagatgaacacagaggttgtatgcaggatagccctggcaggggaaaagagggaaggtcagccaggccagattctctggtagcaatggtcactcttggctgtctcatcctgtaccacactaggtaatagccactctgcagggtgatgtctggttctcaatcttttgctcattcttttctctcattttgatgatgtgtctcttttctccctaactttctgtttctaggcattttcactccatacccaagctgactagacttcctcaggcaccattgccctcagctccatccagtttcctgcctttcaggcccactggccctcccctccttggctgctgtgagacaccggtggtctccttggctgaggctcagcaggagctgcagatgctgcagaagcagttgggagaaagtgagcacttctgcatttgtgtgcttgtgaatggcagccccacactgtgttgctctgcatggatcgggctggatggcagagttcaaagaaacaatatggggacatgttacaaatggaagactgagggaaagctctgcttgcttattttttggaaatgtatttcctgttatttctctgatgtgtgtctcatcagttaacaggtagatatgttcaagaggctctagacctggtgctttcacactgtagatagtgtaggataccaccaagtatgctgaatccctgacagactggtggactgctcattggtaggggatgggaggagatgttatgctttgcctatgcaggatgaagtggccaagaaaaagagggccacattcagtgggctcctttgtgtggctattacacttttctgctgtgaaatgctgttaatcaagttcagttcctgacatcattaggttggagcaaaaagggtaatggtaccaaagtgtcagctatggcatctgactgtgaatcctatcttctgactcccaaagataattgaccttatatagttatgtagactgtggacagtcaccttttagaaaatgctagatatatttgtaggctggatgctcatcataaatttagtatgctggtggtcattgatagcttaaaaaaaaagacaaaccttcacatgaatttgctctctcgtagcaccttaagcacaacagttagaaagcagtttgaatgaacttaaactcatttgtcaggcactttctgtgcctgcaaagaagcttaggtgagccagagactgatagggtcaccatgccagcagtttctagtgaagcaagacaacagccaagaatttgcatccccctccctgtagccctaaatgtcatgtggaccaacctatttctttccttcttcctttctttttttttttttttttttttttttttgagacagggtctcactttgtcacccagactgaagtgcagcggcatgatctcggctcattgcagccttgacctcctgggctcaagtgactctcccacttcagccccccaagtagctgggattacaggtgtgtgtcaccatgcctggctaatttttgtattttttgtagagatggggttttgccatgttgccaagactggtctagagctcctgagctcaagtgatcggcccacctcagtttccaaaagtgctgggattacagacatgagccactgcacccagcctagcctatttattttgtcaacccagcaaatggatactttgtctagtgcagggaactctaaagctcagggaagtgaagttacttgttcaaggtcactaggtgggagagatgggcttgaatctggtcttccgctccaggtttcacgtttctgttataccttttctgcttaggatggctttgtcaccatcctgcttagagtatggggctgagatcagctgatcaaactctggggaatccttgcaacaatttttttcctctctttagagaccagtaggaggtgctggtgtttctgacccaaaacttgttactttagcagttgtggcaccagcaatgggtgggcaaaaatgtcccccaagacaaatggcaagagtattttctagtttccatttcttcctcttgcctccttttcctttatctatccacatttgtccatttgtctttgcccaaagggaaggatggaaggagagcactgtccatgaaaaagggtctattgttttgggttaaattggaattacgtcaagtctgaggtcattgactggagatcaaatggtcccagcctagatgaggaagattgtagccctttctttctccacctgaagtcaaggtcctctccaagggccattgcttatccaagctcactgtttgcgttgagccaattttccgtgtggacagtggtgcatggcggcctctcaggtccctgggttaaaatcttgtgcaagagtctgtatggtatctttgcatggtttagagcatgtactgtgtattgtgtggccaatggactggaacatgagaatactgatcattgttactgatagacttaaaacctcacatggccttgattaaaaagtaagctgactatctacaaccactgatttctccctttgccttgtgtttggatggggttgaaggcagtttgaaagaggcaggaaatcacgtatttgttgcatcccttcaaaaatgtaggtgcttaaatttttaatcttcttccttaactaagtgatcctgatgaatatctagtattttgcaaattggaggagagactcatcacaagacttctcaaacttctgcctgttagaatcacctcagtatatgtttccatactttctcagatgattccaatatgtaccaacatttgagaaccagctacaaatggggctaaaagctggcaactggcaattacactaacccctccgaggagtttggcttggttggaagaaacaatgacctcactcctgttgcttaggaggagctacctgtctattctgctgcccatgttcataatccctgaaagaaagcaggcttctgaattttctcctaaattgcacttctgcccacctctttccctatctcctctatgctgggcttctttttacagagaagtggagatgaaggggctcaagggaaaggcctatgatttcaaagggtctatgaaagtatcagcctatgaaatgaaagtcctacctgcctctgtggaatagtattcaatgattctttagacaggagtgatgacattttgcagctctttgagtcatgttggatgggatccaaataaatacttgctttacataggcccttccccagcctcagcaaagagttcttcattctggaggaattagggccatcatatccagcttgacttcatgtcccctttctcttctgaaaaactccaaggtggaactgacatattgaccggttagtttcaggggaaggcaagtacatgtagacaaacaaacattcatgttcacaggtaagctcaatcctgtatgccgctgcactcacaacttgtaactgtgggagtgaatcctacttttagaactttccttggagtctgtcatgaaggattgtagtaggagccaggagcagggccactggacttttccattgtgtatactgatgactttaagatactttattctctacctcttgtgtctcctgctaggaaatacaaagggtgagaattacaacctctaggttacaagccttagtctaattggtataccacagtgaactgtgatctctgacattccacaggtctccttttagtctctattcttagtaatcacacacttccttgaaaatccttcccttctgacaccgcatttgcttcttactcatgtttctttctgcccaggtgccagcactattcctcctgcttccacagctacattgctgagcaaagacttggaagctggctcttcccactacctcaactctgcccagcctgactctcctccaagaggcaccatagaactgggaagaatcctggagcctgggtaccagggcagcagtggccagtgggacatgatgagtcctcagaaagggagtgtatccggggacctatcctcaggctcctctgtgtaccagcttaactccaaacccagaggtaaagcacaaagtggagatggcagcctttgaaaagaagtctcattcagagtctattcttttcctacccaggcaggactgtttcattcctcctccatccctggctcacagagtggggggtataaaatgaaagacctgtatcagggctcaatcctttccaagtacgttcttcattctcctgcccagggcctcagagctctgtagggatatgggaaagtcggggacccacctcttgtgctctcatactcatgtccttccatctctctgcagcctggactctttgcagcccagcctctttgcagcccactctcttagacccctctagaatgccaggcatagatgggactttcttccatcagtcaggagttgtcacaggaaagggtgcaagggtgcagctccccaaccctgcacatatatcctgtgaacaaaattcagtcacagcaagtggagaggtatagctaagctcataaatgctgggatgctactcagttccaacagtaagacaatcgtaattttcaggaaaagactgagcccaaagcaaaatggttcagttaatatccgacgtgagcatccctctgacttttctgcatctttttcctttgtttggctgggggaggggggtggtgtcatcccctctctaatctgccctcagatctctagatccttccaggctattctttcatcttccatattaaaagtgatttcagggaagcattcagtgtcagtcattaactgcatagggtgagtgtaagatcacatacttttactttaggccttctttctaagggtgggaggaagggctttgtcccttgctaaagaatgctcactcatgtgtcagtaagaagaaaggtagagtgaggtctcacctatcatcctcatagtcacacccaggaggtggccatacctttccagatgctaggcaggccttgtccagagccctcagttatttttctaaaacatgtggaactctcacaagacccctgtgtgggaggaggcccatggagatgttttagcaagtgactgttatgtgtttgaaagcacattgactgtttaaacaaactaccattcctttgggtgtccgtgtgacagcacacagttggcagaagactagtgatatttacaggtcttgctgcaaggcccctggctaggccccacacccaccagtaaccaggattctccatctcccacctctctccatgtcctgttggtttggctacagggactgccctggtggaagagcatcttggtgaaatccagaacttgcgccagcacctagaggaatccatctgcatcagtgaccacctacgggagcaactggaacaccagctgggctctactgcccatggaagtggtaggagaggccaagaccttcctgtttctggctctatttagggacctttaggcagagcttcacagatattctttacttcacttgctccttataaatagtccaacaagggaggtgggcaagtactgttatccctactttctgaatatatctgagtttagagagtaactctctttaaggcagaactagatctggtccccagaatcacctgacatctcaccccatacttaatctgcttatatactgcctgctgatgtatgtgcctttgttgcgtgattgataagtggtggagccaggtctgtaagggtcctcccaactccacccctggccactttaccaaggtggcctttctccttacactctccttccaagctactgtcacatggaggccagtctttccatatgtttttatcttgcctataccatagcagcagctgtttagggagactgagactcttgcaccattgcagttacggcatgtgatgatgcacgcaaagaatccactgagaagaggcacacagaaaacatgtacccagacccccatgcttcattcagggccaggccttgagtccttggggttttctgctgggttggggcagtatctttgagagataaagaatgggaaacttttggaagcttctgttacccaaaagtatactttctgggacaggatccacttctaacttctacagtcagggcctggagtccatacctcagctctgcaatgagagcagagtcctcagggaagaaaattgaagacttcaggctcagctgagtcatatttccaaaggtacatggtcaaaacccacaaactgtggtcactcttaagtttcgttcttccctggccacactaatcaccaactggagaagcaaatagaagaaggtagagataacagagctactcagatccaccaacccaaactcacagctattctcagtctagagaaggctgctttctaagatgtgccaactatgggcccctcagactcctagtccccaggagtgaagagctctaggaaatccatcatttctgtacaacccacctgcatatatccagagtcaccagctatcaatctggataccagtctggtatctgttctacctcccttcactcacaactgatttggaaccaataaaggagggagtgcaaatgcctatcttccctctcaactttctccagactttattgcagcagcatgtgttgctcctggccctgctctgccatacctctgcctcctcaccacatccctcactcatagactcagggctcctctctggccagtactcctatgactccatgccaagtggcaccagcaaatgccccccagcactttcccagccttagccagggggcactcacaggtgggcatcatttctcgtgtggctgggagacagctgaccttggtgttcgtctacttgatcaaatcaatgtattatcgataacaaagtatttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaa

SEQ ID NO: 1097 - DNA, 1121 bp, Homo sapiens
taatgaggacaaggagctttattttttgatgaggtcaggcacaagcactgccaatccttcacaggtacaggggtaagggaacatgtgacatcctggacatcagacaggaagtgccttctggggagagctcagaccttccacaggaaaacccctagctcagcctgtgaaagccagaagagggtatctgggaactcatgcatcaagatggggttttcctgggcccttgggattcttgtttcctccaaaatcgcttgtctcagcatcaggatccaggtcagcagcagcctccagagccatggccgcagccagagcccccgccttgctgaccactgcccctgtcacaggagttgggcctctggcgccggcatcggtggtggcgcctgtggtggttcaggaagcagccgccctcggagctagggccacagcccccagagcttggggcacagccagaggaagctggaggcagacactgtactgggctctttgggggacacttgggtgagggacacttgggtgggggttggcactgctgctggttctgctggcaggacatcttggcaggagttgagttgtcctggacaaaacaaagccatttgttagtccaaaatctacagtccaatgtctctaagaccagcggcctcctgaggcaagagctgcaggaaggtgagggaagctgatgtggagttggtgggacatgccagatgcctctcactttgttctccaccagggacagattgctgtgagtctaagtgggcatccatgtttctgtttctccaaagagcctctaggaatgtacccttttgacaaaaggcattctggagaatggagatcataggaaacatgtgccagcctgagtagaaagaggatgggaaggaatcataagcttctgtggcctttgcaggtcatggaattgctgtcagttcctgcagggtctccctcctggccccagttcccacattggtaccctctctgccatcctctctccgggcttttgtttcagatctctccatttccctctcctgctatgaccttagttttctgttccaacatcccaagttgagtcccatcccctgctggacactcaccaggtgcagaggaggcaggagaaggctgttcctgag

SEQ ID NO: 1098 - DNA, 1119 bp, Homo sapiens
taatgaggacaaggaactttatcttttttacgaggttgggcacaagcactgccaatccttggcaggtacaggggtagggggacatatgacatcctgtacataaaacaagaagtgccttctggggagagctcagatcccccacaggaaaacctccagctcagcctgtgaaagtcagaagagggtatatgggaaggcatgcgtcagatggggctgttcttggcctcttgggattcttgtttcctccaaagatcgcttgtctcagcatcaggatctggatcagcagcagcccccagaaccgtggcagcagccagagcccccgccttgctgaccactgcccctgtcacaggagttggacctctggcgccggcatcggtggtggcgcctgtggtggttcaggaagcagccgccctcggagctagggccacagcccccagagcttggggcacagccagaggaagctggaggcagacactgtactgggttctttgggggacacttgggtgaggggcacttgggtgggggttggcactgcttctggttctgctggcaggacatcttggcaggagttgagatgtcctggagaaaacgaagccacttcttagttcaaaatctacagtccaacgtctctaagaccagctgcctcctgaggcaagagctgcaagagggtgagggaagctgatgtggagctggtgggatatgccagatacttctcacattgctctccacccgggacagattgctgtgagtctaagtgggcacgtgtgtttctgtttctccaaagaacccctagggaatgcacccttttgggaaaaagaattctgtagaatggatgttacaggaaatgtgcctgcctgagtagaaagaggatgggagggaattgtgagctctgtggcctttgcaggtcatggaattgctgtcagttcctgcagggtctccctcctgcccccttcccccattgctgccctctcacagtcctgtatctgggtctttgtttcaaacctctctgtttccatctcttctgctatggccttagctttctgttctaacatcccatatcaagccctgtcccctgctgaatacttaccaggtgcagagaggcaggagaaggctgttcctgag

SEQ ID NO: 1099 - DNA, 140009 bp, Homo sapiens
ttatttttggtcctctttttttcttttattgcaaatttttgaagataccagaacttctataaatgttaaaaaccagaaaataaacagtgtaattataggttcaattgatgatactaactagtgtgacttggctgtcaaatgcacactcttgttgatgacataattatttaaaatataattggacgatgaaatatttctttaagtataatcatgttctgccctatagtaggttttatagacacagttgtaacagttatttcttcaaattcaccatattttactaacataatctgcaatatagattagtggttgacatataatatatcattggaagaataagcccttgaacttataattttacttttattagtttgtagccttgaaacatcaaagacattagtaatcaaaatctccagcacttggataggtaatcacttggttacttttctcagttgtttgctttactctgggtacaaaatggaaacagtaatgaacaaataatctttaagtactctttgaccacggtagtgtgatgacatgttgcttgttgagaaaatcttcctcctcctcatctgtactgctctcagaaagtgacagcaaagactgaattttggtatctcttccagaacagctgaaaatacataacaagatcaatacacaatatacagaaccgggtttcaactcttcatttatcttctgatcaatactacatatgttggagttgctggaggcaagcagatgtgagggagctgtatcagactggggccataattttcaatgtgcccaatataccaagcctccttttaatgagaaattctcatcattctccctctcccaagaaatacagccacagtagaatcaaggagagactttatggtctctgattgtgtcttttgttgatgattcagaggcactttagaaacctgcagagcctcagggtcatcattaagaacattcatcatcacattggctgtttaatagaatcccagtgaatagactgccagataaatcatctcttttgtatactgtaaattaggactatgtagatagccagtcaagatatgctgaagcaaaaattaatgacggcatttgtttgttattttattttgttgcattttattggtggcagcagggggcaccttattctgttagtaaggtccccttatatttttagtattgaatgtcatttgttttatgaatgatgagaatacttgtaggtgtagtttgtttttaatgatttatctaagggaagaaaatatcaatcttacattgatcctttaaacaaatataaatgataatagaaatgcaaaaatccaggctgagtgcagtggcctgagtagtcccagctgtttaagtggctgaagcaggatagcctgagcccaggagtttcagacctacctaggcaacatgttgataccctgtcttaaaaaatttttttacaagagaaagaaatgtaaaaaccaagaacaacaactcaatgatttcctcttccagaaagaataagaaactcctgattccctttttactgcagtatcagatttcaattaaatttcaatcaaagaaatttacaatacaaataacttattttatacttattttagtctttctagaagaaatcctgctccttcttcaaggaattgcagtgtgtcaataatagactgaaacaatagactacttttctgaaacatttactagtataacctacattccttgtaagctgatctgaccatccctaaatgtattttatgtgaggaaagaatgatatcatacaaattaaaatatgttattgttaattttctaggcttgatttcaagaaagaaacttactatttgattctaaaaaccttattcacattgggtaggattctattaatacaaagtattgacatttattaggttaattaattcaaataaggccattgattttcaatataataagaaatgctgaaggattattatattccaaatatcttttcatttttatgatacatattgtacagtagagaatgatctcttcacattaaagtaacaactttataagccttttactaaatctcgataatagatcagcaaaggacccaaacattctataaagaatgatcatataaagtatacacatgaggacaatctttctatatataataaagataactagttggagcttgtcaaaattttactacatactatattaataaataaactgcaggcttaacttacctcaattcctcaactccacagggacccctcacatgtgaggtcttaaggaaatctgtggaaatctgacttatattcagtgattggctgctgaaatctgggaactcttctgaggttaagctgtaaagcttttctgaagtatctgaaatattttatttcatgcattgtcaaaacataaattcaagaaacaaatatacagcatatggtgctgaatgtttacccagagtaaattacaggcaatacaaagaaggtcagcatagatttttaattattcctcaattttctaatgtttgtgaggtaagtttgatttgagattccaaattggggcatgggtagcaagtcatttttatcatattgatttgtaaatatacattacatttataacatgtgtcaaatgtcctgagacctcataaaatttcaaaaaaaaaatcaaatgaccccctttaaagctacaatattttgcagccactcaacctgttggacattttgttatcttttttcttataagaaataaaagctttactcccacacagtctaagggaaagattagccttggcaaagttgctctttcttttttgacttccttgctttgtttgagtagataataactgttcatatttgaaagcagagaagccttaaatttttcttttcatgaagctggcttatgatttagcctagctaaggacaaatactgcaagttaaacaaacaaagtctttaggcaaatgtatcttcatataaactaccaaaaattcaagtatgtaactaaatatcattgtatattagaaaggctacaatgccttcttttttcactgctgaaattataatgagccacctaacttatacataaagttatactatgatgactgttaaaactgtcaaaattactggttgctattcttcccttttttttttttagacagaatttcggtcttgttgcctgggctggagtgcaatggtgtgatcttggctcaccgcaacctccgcctcctgggttcaaatgattctcttgcctcagcctcccaactagctgggattataggcatgtgccaccacacccggctaattttgtatttttagtagagacggggtttctccatgttggtcaggctgctcttgaactcctgacctcgtgatctgcccacctcggccttccaaagccctttacttttatgagaggaccaaataaacctcctcctggtcacaggaaccaaacatcaacatacatgtgttctacagtggacttgacttttttttttttttttttttttttggtggttagtatcaacttgacatttttgagcaaatagagatttccctactgaaagtaaatcagattattcccactgaaaaatagacctcaataaatttacacatggaagtgtccctaaatttgtttagccccttgactttgaaatcatgatgcatgggtacgttcaataagcttaggatttggttcctgctcccaccatatcctcagcaatcaggactttacctgatctaaatttaggggctctatataagattaattttgaaaaagacaaaagattttttagttaaaattttttaaacctcctaattacttccatcttcacttagagatcagggaattatgggcccatgaagaactaataacttgctgaaagtcacacggccatatagtggaagagctgaaactagaactaatctctggtagctcaccaatattgtaaatcactctgttccagaatctaattctttagctttaagctattatcttctctcctatttttccgtatggtaaaagaagacccaaggcacctttacatgtcctaatgaaagggaatgctcccacaagaaagcagtaaattcaggatttggaactggtagaattacagtactgaaacccaacagcaatgctttgatctaaagaataccagcaggtgagatatccaaactctattatgcatttgagctaattgaatgagcataaagctgttccgagttgtgcaaatagaatgagtctatttttctagaactatttattctcaaaattatatttcagaatacctgtaaagttaacaggaacaaaggtgataccacttgattttaggtaacagaaaaatcaaggcagagaaaaataaaactgctcataacaaccctattgtaggttagtgttaaactcaaaaggtcaattgtacacaaatctgtctgctgatttttctaattcagcaccaggtaagacaggattaacatttatattagaaaagttacaactggcaagtcagttgattgttgagaaataaattatagttaaaccttttctatccctggagtaagagtaccttctctgatcattgaggaatctctttaaaaataatagcaattagactaaggagaaaaaaaatagataaaatatagagttctaaggtgcatttctaaaactgaagtcatttaaaacacatacataaaactatattccatagataaataagcacttacatgaaataaaacactaaagaaagaaatataaaaacttcaaagaatgagaaccaatcagagaggctatttcccaataaggaacaacaacaacaactctaaaggactatctagaatagctacatatctacatcctaatattaaagacagtgtgggccgggcgcggtggctcacgcctgtaatcccagcactttgggaggccgaggcgggcggatcacgaggtcaggagatcaagaccatcctggcccacacagtgaaaccccgtctctactaaaaatacaaaaaattagccgggcatggtagcggacccgggaggcggagcttgcagtgagctgagatcgcaccactgcactccagcctgggcgacaaagccctatttctaacctatttctaacactttagccttccttaatttttattctttccatcttctctcccctctgcactatgtcttgtttatttctccttttcctattctctccatgcttgcatccctttaccttcactctgcccacaccctccccttcttaagtggtgatatggtttggatttgtgtccccacccaaatctcatgtcaaattatcatccccagtgttgaaggaggggtctaatgaatggtgacatgatcatgggagaagatttcctccttgctgttctcatgatagagagttctcatgagatctggttgtgtaaaagtgtgtagcacttctcatccaccccttcctcctgctctggccatgtgaagatgtgcctgcttccccttctgccatgattataagtttcctgaggcctccacagccatgcttcccgtgcactctgcaaaactgagccaattaaacttcttttttttttataagttgtaagttttttttataagttatttcttatagcagtgtaagaattaactaatacaagtgattacaaaattgatttgaagtaaaggtttcaaattatttatgtggcattgttatacagtggcaagacaaagaaatgtgggagtagctttgcctggggttgtgccttgcctctgctatacatttgggggagaccatgggcaattactgcattgcccagagcctcagttattgaatatgaagaaaggaaattaagagtagcatctgccccatctacttcaccaaatagctggtaagatcaaatggagcaatatcacatataaaagcaaccagtaattattattactgattaaatggtgtcatattccttttattaacttttaaatatgttttcacttctatgtgcacccaatttgttttctgcaattcaaagacacactaaagcaaaaagactgtcattctatctctttgtaatttggctgccttttcaagggttatctagttaatttgtgaactataaatcctgattagattagcacttttacagtttaatacattacttaatggtcaacctatgaacagagactccagttactcagaaagccactgcctcactgttttatttcactgacagtatggcctattgtctagtatctggtgcatttttattatttcttatgtaagaaaaagtgctttcatctcttttacttgggtcagttaattatctgtgaagtcatacaaacacaagattgttgtgggaacttaaagaccatgaagattcttaaaccacaaatcagattgagtttgaaacaaataaatcatttttaactattgaagaagtaaatgctttaaagtgcattattactaatactttttcacaatgtgtatttcctaaatttcttcaggctacagcaacatccaaaaactgacaaagtgtctttataagtaagttataccaatatgttaagctcatcaaggaagtagttataatgttatttatataaagctatttgtggaaggaatagtaagtggcatgaactacagctaactataatcctcaaagcaatacagatgataattagttctagaatggaaacagcttttagagtttattaaaaattgggtttaccaagaacatcttactgtatgtaggaagtgatacggaagtacggcagggaagtgctggatagagaaaggcaggtccctggctaaggctccacaccacagaccgaggtgaggacaggcactcctgcttttgtgcacaaatgttgcatttcccaagaccaccctggcccaccacatccccatcctgggcctataaaaacctgagacactagcaggcagacacacaggtggccagatgttgagagcagcacatcagctgaagaagacacaagtggttggacggcaagaggacgtcaagcgatcatgctggcaaaagagtacactgacagactctggcacactggcagcccatcaaccagcgggttgagatggagtttggctagggcagtcggaggagagctggggccaccaagcagcctaactctaggggaaaaccatctcccttctcgcttccccatcagcggagagctacttccactcaataaaactttgcactcattctcaaagaccacgtgtgatccaattcttctgggacaccaaggcaagaacccaggatacagaaagtcctctgtccttgtgacaagctagagggtctaattgagctggttaacacaagccacctacagagggcaaactaaaagatcaccctgtaacacatgcccaccggggtttccagagctgtaaacattcacccctagacactgtcgttaagtgtctatctgtatgatccccgagaggttagagcagtggggcactgaagaagcaagccacaccctcattgcatgccctgcaagggggactagggaacctttcccatttcaaatgggagctctgccaggatcctggaagatgagtgtgaatgaatgtgaaactgtcatgtctgcctctcttccaaaacctcccacttctctcttttctgcgggtaagaagctctgtttcccttcaaaactctgcccttaccagccagtcaaaattcccagacttcgtatcttttctctcatatggtttgaaatggcttttatctctttctttataatgttaagagttttgctacaggctatggcaatgttactaagtaaaacgagcattaggttcagccatcaaaggtgcaaatcagatcaatttttcctagaggtgccatgtatgcctccaccttaacagccacagacacacacagctcagggcacctcttcttaccctttcccctcccagcttgggtccctaggcatgccagcagcaggcaaaggccaagcccaacagccacgagtgggtatggaacaaagctgcgacggtaaccatgaccccacagggtcaacgaatgggtgcttctcacccaccacgctaatggaacctttctttccctggccaaggaattcagcctagtctgaaatcgggtaaaaatataaggattagagggttccagttgtactaagcaaggggttcttcccccagaatcttcccccttttcctcttaaactgtttttcttttttctttttttttttcctcttctaagtgagaggcgtcccccaccaccaactctgtttctaatagggaagttaacagagtaatggcccctgctgactgataactgcaaattcgacagggcacatttgagacactctaaacagatataaacagcctctaaaataccttttcagtcccaaactggactccaagcttcaggctgaggccctagaaagaaaaacaaggtttgaaggattcaaagccaggcaacaggtataatgtaaatgggcagaaccaattcctaccaactaaaccccccacctcacggaaggaggccatgcttcatggcataaacaggctcaggaaactcaaggtttgctgaaagcagggagaaatgggggcaaaggtgagggtggttaattcctattctccaggttttccctgcttcgtgggtacatactgcatcagtatccatggccggcacctgccaaggtcatcggggctcagggataagcagtggagagtgaaaggaggacattcattttctgagtctttgttgaaagaagaaagggaatgagggacacctctattcactgtctttcagaatgggcaaccagttattttcaccacgctcagcctatactcctctggagtgtattctgaaccactaggactgccttgagcctcagaatctggaggaaaagtgcctcttagccctctgcaaaaaggtttggccaaattatgatttacaggaaagagtggcttggcctcaggaaggaaccattcatttctataccatctggcatttggaacttttctatagacgtgaggacagatggcctgaggccccataagtgtaggctttctatagcttgcaaggcaatccagacctttgctgacagagtaggattgccctcctgtttggcatctcagggaaggttgcaaggggcaagctcaagcaactaaaaatatgagtcccaggggcaaccccagcagaggatccagctacctctgaccctgttactcggggtccacccagaccaccctatacagcttcagcttcccacctgcctcctcctaaaaatctttgctctagacaaactccagtctcactcttaaccctccaacaaatgcccagtaaatttgggcctagtaaggtccaggtccccttctccgtataggacttaaagcaaattaagggggatcttggcaagttttcagatgaccctgatagataaatagaggctttccagaattatacccaaatatttgaactctcctggagagacgttatgttacttttgaatcaaaccccaatggacactcagaagcaggctgctctgtcagcagcggagagatttggggataagctttctttcatatatagcgtcagagaaggggatgaatattatccaactggaagagaagcaataccagtaaataatcctaaatgggatcccagtgacgagatggaagactggaaaagaagacactttcaggtgtgcataatggagggcttacgtaggactaagactaagcctctcaattatattaagttgtccatgatcgactaaggatttgatgaaaatcccactgccttcctggaaaggctaagagcggccttgacaaagcacacctctatctcctgattcagtcgagaacagctaatcctaaaagataaatgtattacccaggtagctcctgacatcaggaggaagttgcaaaaatgggccctgggaccagatagtacattagaggacctcctgaaagtggccaacttggtcttttataatagagacaggaggcctaaaaaagcgagaggagatgcaggaaacagacaaaagctttgatgaccaccatgtaagcccacaaaccccaaaattcccaggatgtgcctgctaactgctaaaagatacggcaagaacagttatttctcttccaaagtttaactgctcccataaaacgtttaatttctttcaccagggtgaaacagctcagggtagaatgttgctgttagtatatttcacttcttatctctgtaatctctggcactaaattctttccttgtataatacacatgtttcacccatgcatacttaaccttataaaacttttttttttttttactctcaagcctagaagccatcaaaatccaaatggtcaaccggagcctcgaaagatggctccccttgtctaggaacccttagaccgctaggagtctgactgccatttaccccagaacaatgccccctgtcagcaggaagcagcaaagacaggtcacagtccatattctaaaggtagttagatgtacatcttcagaggggagaatgataccggaggggtcgaggaagtgctgagtagagaaaggcaggtccctggctagggctccactcccttggacctaggtgacaacaggcactcctgctttcatgcccaaatgttgcattttccaagaccactctggcccaccatgctctcattctgggcctataaaaacccgagacccgagtggaaaaacacacaggtagccagatgtcaagagcagtacatcagcggaaaaagacacaagtagctggatagcgagaggacgttgaggcagcacactggcagaagagcacaccgacagaaaccagcacaccagcagaccactgaccagcaggccactgaccagcaggatggggtggagtttggccagagcagttggaggagagctggggctgctgagtggcccaactccagggaaataccatctcccttctggctcccccagtggtggtgagctacttctactcaataaaactttgcactcattctccaagaccacgtgtgatccgattcttctggtaccccaaggcaagaacctgggatacagaaagccctccatccttgtgacaaggtagagggtctaactgagctggttaacacaagccacctatagatggcaaactaaaacggcatcctgtaacacacacccactggggccttagcatctgtaaacattcacccctagacactctcgtggagttggagccccacagtcagcctgtctgtatgctccctagaggtttgagcagtggggtactgaagaagtgagccacacccccatcgcacgccctgtgagggggacgggggatcctttccggtatcaaaagcactacctattggtttcttatataacttaacagttttttgaggacttactatgtgctaggcactgttaattgtgtgtgtggagagagagataagttttcataaatataatatctcatatatataattttaattaatgatcaaataattttattagataggttctattattatgctcatctttcaatatggaatctgatgcaatgacagattagggaagtaatttgcccaatattatgaagctagtaagtggtggtttcgtttcaaaccacacgccctgacaggggaacctggttatcaaccaatctgctttctgtctcttgtctctcgattcatcatgatgttgtgcctgcaacacacacacacacacacacacacacacacacacatctgtccatgctaggtacttctagaatggcactctgatatcagccacagcaatcagaatccaaggagaaactgtttccttaaacacctctgcccttctcaggtacttctagaatggcagtctgatatcagccacagcaatttgaatcaaaggagaaactgtttacctaatgtagttattttctgtcttattctcccagctccttaacatggttgtttttcatagaacttagaaagaagaagtggatgcatcctagaaatagcagaaaacaagtcagagaggttgctgtacacaataatgcagctttcacagagatttgaacatatttacatttatataagcatccagtggtgtggaggtgtatgtctgagagcaaacctcatgaagtttttccagactgcaccctgagtagtgaaaggtgaatggaattgttctgctcattgacgcaaaacagggtaaaaaggccttgtgcagagtcagtgacttttctacaatgaagccttatgtcactgtagcacttgtcacctcactgactgttgggttgattagcctgatatgtcatcttcttcctttctcagagtgaccgtattcatgaacagtgcactcatacaaagccaatcttcccaacagaaaaaaaaaaaaaaatccatgtctgcgttaagtgtgaaagtggttgccttctgctgttggacatcagcaaagccctggcagttcacaggctaccaagtgtgtgcttgcttttgtatataaaaagttatgtgttctagtgaaaatactgatgttagtgtatgagaaaataagtgacacaggaaaaaactgaagcacataggaacaaagataatttttaaaaatggaaaagctggaatggctgaaaaaaagactagcgtttgtacactattgcattcaatttgtaaataataaaatgtatcaatttttaaaattacaaagctctttttaaaattaaaaactgtatgtttgtccttttagatccagttcagacttcacatactttatttcagaattggcctgtaatgtaacaattatctctaggaagatttatgtttgatttttaataattcaagcaaggtaaatgaatgatgggtaaatatggattattgactttttcctctaacccctattaaataaatagaaaaagcagaataataaaaataaaatcataaaaggagctaaacaaagggatacaattgacataataactttgagaagagtcaaccaaataaaatttattgaggtgtggctgggtgttattccaatacacagtgtgtgcccaacacacagacaccaaatgaagaataggaaagagacagtcataaaaagaacaggctagtctcaccaataccacgtcaatagggagaaaagtaggtgaaaagaagtaaggaggagacatctgaaatccttattaaagctggctaatcatctatctgaaaaatcttaacagagacaagaaaattgcaaatctgaaggtttccccacagagacagcacacaggaaaacaggtcaatagaaatctggcatttaataaaatccagaaaaagacaagaaagcccagatctttcaacagagaaagctgagctccccagtcctatcctcctccccatgccttggagctagcaggatacagaagagtacaatacagaacccgcaaacagtagctccccagaaaagactgagagagctcagtaagagtgaagagaatttcaggaagaatttagtttcactatatcagaaaagatggaaggtaggaacaaagccactcacaataagcataggcaagtgaaatccaaagaaatgacacaactagatatataaacaaactagtatctttagcatgtaacgggtgaaaaaaataaaaaacataaaatttggtagaaaacatagatcaggaccataagattttccacaagtcctttggctacaaaagaagtaatgaaagcaaactttttgaaaagagcaaaattaacctcaaagatggagcaacaacatgacaggcatcaaaggaaaactaattaaatggtcacctgctcctggattggatcctataccagaaaaaaacaagctgtaacaaacatcaatggggtagttttaaaaaactaaatatgccatgtggattagaaaatcacattgtatcttgtaatgtgagcttcctgattttgatcattgtgctatggttatataagagaaagcagtttttctgggacacacacactgacatatttttttgtaaagtgttacaatgtttttaacttcctctcactgttcagaacaaaaggaggtacaaaaggagggtgtgtatgtgcatgtgtgtgcacacgtgtgtgtatgcaaataggacaaaacatagctagtgaaccgggtacagtgtatgtgggggaagagttctttgtactatacttgtattttgcaaattttctgttttaacttatatcaaaatagaaaactaccaaaaaatgtcaaagaaaaagttacaacatctttagagaatgacttttttaaaagtcaagtgataaagagtacactataactaggtaaaaattaaaatcctgacatatagacaagcttgagataatgatagcaaatacaaagggaaattaaaaactagctaaaacaattgaagaaatataagtaatacttttttaaagagacgccaacataaagaaaataggtttctcagcaggagaaagcctaatggaacagaaaagcaattcaaagatataaaaacagaaaatttctttgaaaataacgggtaatgtactctacagacagagagagaaccctgtgtttaaaaaaaatgctgaattattgacactaaaacaaaatcctggaccagttactgactttcaaggattaagaaaaatttctccaagcattcagtcaggaaagaagcctgtcacatgtgtgtgtgtgtgtgagagagagagagaatgagagagagagagagaaagggagagagagagacagagaatctaggaggcttcagattacttcacagcattcggagccagaaaatggcaaatcattatatacaaggtttaagacaaaggtgaccaaatgatattatcctcggccaatttgccatctaaatagaaatgtagcaggtattctcaaatataaagaaaactcaggtaataaaacttctataaattctacctgcagggaaaaattatatgataattaaactgaaccaaacaaaagtttaatgaaaaaagctgtgataaagggctaactagcaccatattcagggtcagacgacaacaggaaaatgtctgctacatacagaggaaaggaaactgtgacctactaaatacatctaatgtgccattcggcaataagacaaaaaacagacattatcatgaatgctataataaaaccatcaagagatgaaatcaagataaaaggctcaggattgggaagtcatagaagaaaatgctggtactaaacatttaatccatattgattttcactaagaaaaaaataaaaggaaaactttacaaaacaagaaactataactacaacaagggatgtattcagtatgatctagattagcatgtggttttaaaaaataaacaaatgagccctcatcttttattatagggaattattactatctgaaactaaagcatatagttagaaatggcctccattactctttatttttaccttttctctcaatttttaaatttatttttaatttttgtgagtacaaagtaggtatatatatttatggggtacatgagatattttgatacaggcatgcaatgtgtgataactaaatcatgaaaaatttggaacacatctccccaggcattacgcttttgtgtttcaaacaatccaattatattctctagttatttttaaatgtacaattaaattataattgactatagtctctgggttgttctatctgacactaagtcttattcattctttctattttcagtacccattaaccattcccaccactccacccacactccccactatacttcctagcctctggtaagcattcttctattttctatctccatgagtttaattgttttgatgtttagatcccacaaataagtgataacatgcaaagttcgtcttgctgtgcctggcttatttcacttgacaaaacaatctccagtgccatccatgttgtcacaaatgacagaatcttatcctcttttatgattgaataatacttcattatgtatatgtaccacattttctttatccattcatctgttaatgaatacttaggttacatccaaatcttggccattgtgaacagtgctgtaacaaacataagagggcagatatctcttggatatatgggtttctttttttactttttaaattgttgtgggcacatagtaggtgtatatatttatggggtacatgaaatgttttgatatagacatgcaatgtgaaataagcacatcatggagaatggagtatccatcccttcaagcacttattatttgagttacaaataatccaataacattctttaagttattttaaaatgtacaattaaagttattattgactatagtaaccctgttgtgctatcaaatagcaggtcttatgtattatttctaactattttttggacccattaaccatcccacctccaccccaccccaccccaccccaccccactaccctttcaagcctctggtaattatccttctattttctatctcaatgagttcaattgttttgatttttagatcccacaaataagcaagaacgtgctataattgtctttctgtgcctagcttatttaacttaatgtaatgatctccagctccatccaagttgctgcaaatgactggatctcattctcttttatggctgaatggtactccattgtgtatatgtatcacattttattttccattcatctgttgatggacccttaggttgcttctgaatcttagctattgtaaacagtactgcaacaaacataagaatgcagatatctcttcaatatactgatttcctttcttttgggtatacacccagcagtgggattaatgggtcgtattgtagctctatttttaactttttaaggaacctccaaactgttctccatagtgtttgaactaacttatgttcccaccaacagtgtacaagggttcccttttctccacatgcttgccagcaggctttattgcctgtcttttgtataaaaattttatttgtggctattacaaatggaattagttttttatttctttttcagattgttcactgttggcatatagtaatgctagtgatttttgtatgttgattttgtatcctgcaacttactgaatatgtttatcagttctaatagtattttggtggtcttcaggtttttctaaatttaacatcatttatccacaaacaaggattatttaatttcttcctttccgatttggatgccctttacttctttatcttttttaattgctctaaaacatacagtactatgctgattaacagcatagttatgtttcaggtttaagagggcaaacttttaggttctccctattcagtttaatactagctgtgggtctatcatagatggcttttattatgttaagaccttctatacccagttttttaaaggttttcatcatggagggacgttaactttatcaaatggtttttcagcatcaattgaaatgatcatatggttattgtcctttattctgttgatatgatgtatcacattgattatggccattctttcaggaggtggtatcacattgtggttttgatttgcatttacctgatcattagcgatattgagcattttttcatgtgtttgttggccatttgtgtatcttcttttgagcattgtctattcatgtccttagcacactttttgaagggatttttttctttttttactgatttgtttgagttcattgtacattctgggtattagtcctttgtcacatgtatagattgtgaagattttctcccagtctgtgggatatctgtttgctcttctgactgttccttctgctgagcaaaaactctttagtttaattcggtctcagctatttatctttgtttttattgcatttgcttttgggttcttggtcatgaaatgcttgcctaagccaatgtctagaagggtttttccaatatccccagtgagttttgattatggctataatcataaaacagtagatgttggcatggatgcgttgaacagggaacacttctacactgctggtgggaatgtaaactagtacagccactatggaaaacagtgtgaagattcctttaagaaccaaaagtagaactaccatttgatccagaaatcccactactgggtatcaatcttctagggtttttatagtttcccatcctagatttaagttcttaatccattttgatttgatttttgtataaggtgagaaatgaggatctagttttattctccaacatgtggctagccaattatcccagcaccatttgtttaaaagggtgacagtgatagtttgccttcgtctttactgatttggatgccctttgtttctttctgttgtcttattactctggctaggacttcagtactatgttgaagaagagtggtaagagtagacatcctggtcttgttccacttctcagaggaaatgctttcaacttttccccagatggcttttttacattaaggtatgtcccttgtttgctgattttgccgagagttttaatcataaagggatgctggattttgttgaatgctttttctgcatctattgaaatgatcaggtgatttttgttttaattctgtgtatgtggtgcatcacatttattgacttgattatggcaaaccatccctccatccctggtataaaatctatttgatcaaggtggattatctttttgatatattgttggatttgattagctagtattttgttgaggattttagcatctatgttcatcaaggatatcagtctgtagttttcttttttggttatgtcctttcctggttttggtattagggtgatgctggcttcatagaatgaactagagagggttgcttctttctctatcttgtggaagagtggcaaaaggattggtaccaattcttcttcaaatgtctggtagaattctgctgtgaatccgtctggtcatggacccttttttttgataatttttaaattaccatttcaatctcactgcttgttattgatctgttcagggtatctaattcttcctgatttaagctaagagggttatatttttccaggaatttatccatgtattctaggttttctagtttatgcgggtaaagctgttcttagcagccttgaatgatcttttgtatttcagtggtgtcagttgtaatatctcctgtttcatttcttagtgaggttatttggattttctctcttcttttcttggttaatgttgttaatggtctatcaattttatttatcttttcgaagaaccacctgtttgtttcatttatcttttgtattttgttcatttgtttcaatttcatttcgttctgctctgatcttggttatttcctttcttctgctgggtttgggtttggtttgttcctgtttccttagttccttgaggtgtgaccttagaatgtcagtttgtgctctttcagtctttttgatataggcgttcagggctatgaactttcctcttagcaccacctttgccttaccccagaggttttgatacgttgtgtcattattgtcattcagtttgaagaatttttaaatttctaccttgatttcatttttaatccagtgctcactcaggagcagttatttaattttcatgtatttgtatggttttgaagattgcttttggagttgatttccagttttattccactgtggtcagagagtgcttgatataatttcaatttttaaaaaatttattgaggctcattttatggcctattttgctttttaacttgtatttttgttttataagtcctgtgtgaattaagctttaaacaggttctgttttgatgtgtttctagggtttgtttcaagatttagagctctttttagcagttcttatagtggtggcttggtaatggtgaattctctcagcatttgtttgtctgaaaaagattgtatctttccttcatatatgatgcttagtttcactggatacaaaattcttgtctggtaattgttttgtttgagaaggctgaagatagggccccaatcccttctagcttatagggtttctgctgagaaatctgctgttaatctgataggttttcctttataggttacctggtgcttctgtcttacagctcttaagattcttccctttgtctcaactttggataacctcatggaaatgtacctaggtgaagatctttttgcagtgaatttcccaggtgttctttctgcttcttgtatttggatgtctaggtctctaggaaggccgggaagttttcctcgattattccccaaacacatttttcaagctcttagaattctcttcttcctcagaacaccaattattcttaggtttagttgtttaacataatctcagacttcttggaggctttgttcatattttcttattctttttgctttgtctttgttggattgggttaatttaaagaccttgtctttgagcttcaaatttcttctacttgttcaactctattgctgagattttccagaggattttgcatttctaaaagtgtgtccaaagttttctgagttttttattgttttgtctttaagctatctacctccttgaatatttctcccttcacttcttgtatcatattttgaatttccttgcattaggcttcgcatttctctggttcctccctgattagcttaataactgatcccctgaattctttttcaggtaaatcagggatttcttcttggcttggatcaattgctggtgagcatgtgtgttttctggggggtgttgaagagccttgttttctcatattaccagggaaggttttctggttccttctcatttgggtaggctctgtcagagggaaggtctagggctaaagcctgttgttcagattcttttgtcccacagggtgttcccttgatgtagtactctccccctattcctatggatgtggattcctctgagctgaactgcagtgattgttgtctctcttccgggtctagccacccagagagtctacctggctctggactggtactgggtgttgcctgcccagcatcctatgatgtgaaccatctatgggtctctcagccatggataccagcacctgttccagtggaggtggcggaggggtgcaatggactctgtgaggttcttagctttggtggtttaatgctctatttttgtactggttggcctcctgccaggaggtggtgctttccagagatcatcaggtgtggtagtatgggggaggaactggcggtggtcggggccctagaacacccaagattatatgccatttgtcttccactactagggtgggtaggaaaggaccatcaggtgggggtggggctaggcgtgtctgagctcagactgtccttgggcaggtcttgctgcagctgctgtggggaatgggagtgagggtctgagttcactggagttgtgtacctagaaggattatggctgcctctgctgagtcatgcaggttgtcagggaagtgggagaaagccagcagtcacaagcctcatccagctcccacacaaactgaagggcctgtctcactcccaccatgccccaccacccaacagccctcacacccagatcatttccaggtgtggagctatatgggtttgaaaacttgtcccaggctacccgcctcccaactgcaaaaaaaaaaaaaaaaaaaaaaaagtgggggcgggggcttggttcttcccctacctgtggagtctgcacaccagatttgcaccctcccccaaattctggacagaaggcttcccaccccaatcaaatggttacaaagttcagctagagatttgcttatcactgtgtagttttaccccttgctcttttggatccctgtggtgcaggcaggaatggcctggtaggtgacccaacaagctcccagggcctttctgcttcttcctctacccctgtattttgctcggctctccaaattaactcagctccaggtaaagtcggaaacttctcacgcaaacagaacttcagctttcagcttctccagtggggatgtatgtttggaagagggggtctctctttcccacttcaacagttggggcactcagtttttgtgggtcggggggggcgtctcccaggtcctgcaggagcagtctgctttcttcagagggtctgtgggtcctctcaggatttctggtttgctcttgcagtccatctggaactaaaattcacaatgcgagccagccactgcctgttgctctttctggagctgcaatctagtcctgcctccagtctgccataatctcccgcattctctaaccgtttttgttggaacactttcaataggattggtataagttcttctttaaatgtttagtagaattcatcagtgaaaccatcaggttctgggcttctttatattgggagacatttttggtttgtttgtttgttttgagatggggtttcactcttgttgcccaggctggagtggaaaggtacagtttcagctcactgcaacctctccctaggagacatttttattatggcttcaatctcattgttattggtatgttcaggttttggacttcttcgtggttcaatcttggcaggttgtatatgcctaggcatttatccatttcttctagattttccagtttattgttatataattgccatagtagccactaatgatcctctgaatttctgaagtatcagttgtaatgtcttctttttcatcactgattttatctatttggctcttctctcatttttccttaatctggttaaaggtttgtcaattttctttatcttttcaagaaaccaactttttgtttcattgatcttttgtgttgttttcttccattcaaattcatttatttctgttctgatcattagtatttcttttcttccactaatttgaggtttggtttgtgcttgcttttctagttcttttttttttttttttttttgagatggagtctagttctgttgcccaggcttgagtgcagtgatgtaatctcagctcactgcaaccttcacctcctggctcaagcaattctcctgcctcagcctcccaagtacctgggattacaggcacgcaccactgcgcccaactaatttttgtacttttagtagagacggggtttcacctgcctcagcctcccaaagtgctgggattacaggcatgagctatggtgcctgtcctctggttctttaagatacaggttttatttatttgaagttattttgtttttgtttttatttcatgtaggcacatattgctacaatttctctcctactgctttcattgtatcctataggttttggtatatggtatttacattatcatttgtttcaagaaatttttccatttccttcttaatttatacattgatacactggtcatttgggagcatactgtttaatttacatgtgttttccaaaatttctcttgttactgatttatagttttatttcactgtggtcagagaatattcttgacattatttccaatttttggatattttatgacttgttttgttacctaacacatggtctatctttgagaataatccatgtgcagaggagaagaatatgtattctgcagctgttggatgaaatgttctgtaaatatctattaggtccagttgttctatagtgcatattaagtctagtgtttcttcattgattttctgtcttcaagatctgcccaatgcagaaagtggagtgttgaagtctccagctattattgtattgaggtctatctctctctttagttctaataatatttgcgttatatatctgggtactccagtgttggtatgtatatatttgtcaccattataccctcttgctgaattgacccctttatcattatataatgaccttcttcttacagtttttgtcttgaaatctattgtgtctgataaagtatagctactcctgctcttttttggtttccattgtcatagaatatcttttttccattcctttattttcagttcatgtgtatctttcaggtaaagtaagtttcttataggcaacacatcattgggctttatttttccatccattcagccattctgtcttttaattggagagtttagttcatttacattcaatgttgttattgataaggacttactcctgccatttcattatttgttttctggttgttttgtagtcttctcttctgtctttccttccttcctctcttccttttagtgaaggtgattttctctgctggtatgctttaatttacgctttttatttttttatatcttttgtatgtttttcaatttgatgttcccatgagacttgcaagtaatatgttataacccatcattttaaactgatggcaacttaacactgattacataaacaaagaaatgcacaacatgaaaactaataaaaactctatactttaaactatgaacctgctttttaactttttgttgtttctctttatgtcttactgtactgtctgtgtcttgaaaagttgttatagttactatttttggttgattcatcatttagtctttctacttaagtcaggaaaagtttacacaccaccattacagtgttatactattctgtgcttttttctgtgtttataccagtgagctttatactttcacagtcaacaatctcagcagtttacctgaggttctattctactgcagctaagttggcactcagaccacaagacaaagtccttcccactcttctcttccctttctataggcagaggtctctgtggccttgaccacccctagtccatggggatttctactcggccaccaccaatgtttgcctaaagcccacgggctcttccatcggcttatgatgaatgctgtcaggcctgggactcacccttcaggatactgggctcccatctggcccatgccaggccaagtctagaaatactgttcaagaatctaggtctggacttcaggtccccacgaacctgcttgttgctctattccactgtggccaagctggtagccagggtacaagacaaagtcccctttacttttccctctgctttgcaaaatgcaatttttcatcattttcattgtagttgccacagctgagaatgtgctgggtctcccctgaagccagcacatcttagagtccaaggcctgtggtgtactcccttggtatcactggagattattcagggtctgagggctcttcagttagcaggtgatgaatcctgccaggactgggttctcgtcccttcaaggcagcagattcacttttggctcaggttgtgtcaagaaatatcatctaggagctaggacctgaaatggggggctcacaactctgttcagtgccctctcctactgtggctgagctggtagccaagaagcaagacaaagccctccttactcttcactctctttcattatgcagaaggaaggagtcacttttgttgctatgagctgcatagcctggggttgggggagggatggtgcaagctctcccttagctgtgccaggtggtgtctctctaggtcatgtgccatgcttgttcactgactctaagcccagcctagcactagctgctgcctacaaattgtagtccttgtgtcctagattgcctttcaagtttacctatgacccccaggcacttcagctcaatgtggcatggcttcccaaggaagtcaagttctgaccgctggaatggatgattcccctctggaatgtggctggtccaaatgcttcctccatgcatgggcactggctgagcccagcacagctttattctctgctgtgaccaggtagcactgagttgaatgtgaagtcctctagttgatgtgctctccctccccagagagcacagattctctctccacactccagggttgctgccaggaggtgggggaagggtggcattggtaattcagtatgtctctcttgcccttttcaatacctctttccacaacatgaagttaaaaccaggtactgtgattactcacctgagttttggttcctgccacggtgctttcctatgtgtagacagttgttaaaatttggtgttccagtgtcggggaggatgggtaaatgaatgatgtaggcttctgttttgccatgtttctcctccccttttttctcaacttttgaaggtatatttgtaaaaataatggattaaaccatataaagttgccaatattctactttttttggtctacaaaagggtaatttcgtacagtttgtaagatacaatgaatctttgtgagtctctcttcaaaaggtttagcctgttaacttccttaccctttgttctccaacttaactttcttgtttctccttgccaaaagttactataaacagcttacccccttcccgtcagttctaatcaataactcacatctcttcccttggttacctgtacccatttttcccttgaaactgcacgtctcacaagctccaccactgtacctcacatccccctcccttccatatttagaaaaatatttacaagtagccaattgggtcagctcagattttgcggtccaaccccagcccacgggggaagaacacagaaatagggatgacgttaagggtataaaaaactcccggtcccctttgttcagtgtgcacttgcaatcttgattgacgtgagtggcacccttttgcaaaagtaaattgccttgctgaggaaactaaatttatattcgagtgctgtttcttttgaggcatcggaaattcatttataacaatttggtggctcgtatggggagcccattcttctctggggagggatttccggtcctttcccgtgagaaggcacgccccgccacctcattgcagtggcttcaggttgaggaatcgagacccacccagtgtgatgaataaacccggcctctcagcaacccgggaaaggaacaagccggcagcttgggaaaatggggctcacatactgcagcgaccaggtaaactctgtgcacaaaccaaggtaagaaaagtcacaggggcgacaaagtatttccttggaagttgaaagtgtgtgaatggtaacaattaccactgctgtgcagagtaagtccaatctgcggttccacggtcacctcatatggcttagggtggccctttgggggtcccgtcaggggtttatactggcccaccatccatgataagagggacctgaaatatttctgcaagggaagcatccagagtggacgaagctaaagaagggtacaaggaaccttcagcaggtagggctaaaggataggcaagagattcctcatacaagggaattgagcgttaataagcctccagggaaggataggcaagaaatttctaatatgagaaattgagcctaactaggacccaacatgggaaataccccaagtattatgagaagtgaaaaggataaagatagcaataaatatattcccccagatagtcccctaggtctcatgttaaaatattggaaaggtattgagagaactaaacataagaaaaagcaacaaatgataaaatattgctgttttgtttggacccagggtccactcctcaagccctcaatcttctggccagtttgggtcaaatgaggatgtaatgtatcaactcctaattcaacatgtaaatgataaaagttcagtgttctcaagagaaactggactatgctctttgttagagacagggacctgttctcctctatcccttaaaaacaactagggaaaagcccgatctagcatccgacaatgaagactcaaaaaacctggtttccatggctaaggactccagcgcatgggatcccctagaccaccttcccccactcattgcccccaatccttcccctcaggcagctgctgctgccctggatcctgccccagatccttcttctccttacgttattcctcctccttataatcctgattcttgggaatcatcatgccataaacctgttccctctcagcctaagtgcccctccctgaaggaactccaacatgaagtagaacaatgtaaaagagatatccaaaatttctcatttccctccacatctatggagtcagctctgactctcttccgcttgagagaggtaccacaaggaggaggtgctattggctttgtaagtgctcccctaactagttcacaagtctggaatttaaagaaggaacttaagccattattagatgacccttatgggttagcagatcaagttgatcaatccctgggacctcagttacacacctgggttgagttaatgtccattttaggcattctcttctcgggggaagaaagagggatgatcagtagggctgctatggtaatttgggagcgtgaacaccctcccagtcaagacgttcctaccgcagatcaaaagcttcctggccaagacccctggtgggacaataataacccagctcacttggaaaatatacaagacctaagggagatgataataaagagaattagggaatcagtaccctgaacccacaacctctctaaagcacttgatatacaacaggaaaaagatgaggggcctatgaaatttctaaacagattgaaggaccaaacgagacaatattcaggcctaaacttagaagacccccttggacaaggaatgttaaaactccactttgtcactaagagttggccagatatttcaaagaagatacaaaaattagaaaattgggaagaccgacctctgagtgaacttctcagagaagatcaataagtatatgttagaagagatgaagagaaacaaaaacaaagggcaaaacttggtggaaccaaatccacatacttctaaacaaagcttccagggggccggaaactataccaggtccagacccccgtttaaaagaaccaagcctccatctagaggacccagaccctcatctaccagaccctctaaagagtatgggggaacaacgttgcaaagtcctggagctgggagagaagaaggacaagagaggtgttacagatgtggaagggcaggccacttcaaaagagaatgtcccaaattacaaagggagagacaagccctttccctcattacctctgaggaggagtagggggctcaggggctctgtctcttttacttcaagtcccaccagaagcccttgatacatttagaagtgggacccaatcatgagcttatcacctttctagtcgattcaggggccgctcgctcctctgtttccctctatctgacattgcctgctcttcagaagacctttgagtctctgggataaaagtggaagggtttaaagcaaaagtcttagaaagtacagaagttaaattctaagattgattgactcatatccaatttttattgatccctgaggcaggaactaacttattaggaagagaattaatgttgaagttaggcatagtcttataagttagtctaaaaggattccttgcctcattaaatttactcaccaccacagatgagaaatgtattcactcgttgtgaaggaaaccaaggaaaacttcagattcccacaatccacatcaagctaaaaaccccagaggaagtggtgaggaggaagtaattctctattccttcagaaggacagatagggttaaagcccataattgaaagtgtcatgaaagatgggcttcttgagccttgtatgtctctttataacaccccaatactgcccgtcaagaaatcagatgggtcataccggttagtacaaaatcttagagctatcaaccaaatagtaccaactattcaccctgttgtccctaacccttacactattctcagtaaaattccatatatccatcaatggattactgtaacagactcaaagcatgctttctgggcatgtcccctagctgaagatagctgaggcacattcacttttaagtgggaagacacccagtcagggtaaaaacaacagtatcagcagacagttttgccccaagggtttgcagactcacccaacctctttagtcagattttagaacaagtgctaggaaaggtttctgttccaaagcatacatgcatgctccaatatgttgatgatatcctcatatcaggagaggatgtggaaaaagtaaccagtttttccatacatatccttgatcatctacattctgaggggctacaagtctcaaagaaaaagcttcagtatgcagaacctgaggtcaaatatttaggccatttcgtaagtgcaggcaagtggagaatagtgccggagcaagttgaaggcatcgtgtatttacccttgcctcaaactaagcatgagctcagaaaatttctaggattagttggatactgccgcttatggattgactcatatgccttacacagtaagctgctataccagaagcctactccagaaaaacctgaccatctcctgtggacttctgaggaagtcaaccaaattgaggaattaaaagaaaggcttatgactgccctagttttagcttcgccttctctagaaaagccctttcacctttttgtcagtgtaaataatggagtggctataggagtgcttacccaagagcacagtggctgccggcagcctgtagccttcttatcaaaggttttagacccagtcacttgtggatggcctcaatgcatccactctgttgctgctatggcaatattagttgaagaaagcagaaagttaactttaggggtaaagttgactgcaagcacaccccacgaagttagagcaatactaaatcaaaaagctgggaggtggcttactgactccagaatcctgaaatatgaagttattttgctggaaaaagatgatttaaccttaactactgataattcactcaacccagcaggtttcttaacaggagatccaactctaaacagggagcacctatgtctcaatttaattgactaccaaaggtcagaccagacctaggggataccaccttcaaaacaggatgacacttattcatagatggttcctcctgggtgattgagggaaaaagacacaatgggtattcagtaattgatggggaaactcttgaagaaatagagtcaggcaaattgcctaataattggtctgcccaaacttgtgagttgtttgcactcatccaagctttaaagtaattgcaggaaggaaccatccatattgattctaaatatgcctttggggtggcccatacatttggaaaaatttggactaaacaaggtcttattaatagcaaaagccaagaccttgttcacaaggagttaatcacccaagtattagataatcttcagtttcctgaagaaatagctattgttcatgtttccagacaacagaaaagcctttcttttgaaagctagggaaacaacttagcagatcagatagccaagcaggctgccgtttcatctggaacacctgtctttcacttaaccccttgtcttcctctactgcagtccctgtcttctcagccgtggaaaaagaaaaattaataaaaataggggccaaagaaaactcagaaggaaaatgggtattaccagaccaaagggaaatgctatccaaacctctcctgagagaaatcctgcctcacttgcatcaagggacccactggggacccaaagccatgtgtgacgtagttctcagagttcatgggtgtataggaatttataccttggccaaacaagtcatggacagttgcttaatatgtaaaaaaaacccaacaaacaagttataaagaaatctcccttggtggggaggaatccagggctaagaccattccaaagtattcagagtgactacacggaaatgcccccagttgctcatctaaagtatttgttattaatagtagatcacctcactcactggatcgaagctattcccttttcaaatgcaacggccaataatgtagtaaaagcactaattgaaaatacagtgcctagattgggactaacagagaacactgactcagacaatggaacccatttcacagcacacatcattaaaaagttgtcccaagacctagacattaaatgggaatatcatacaccttggcatccatcttcatcagggagagtagaaaggatgaatcaaactttaaaaaatcacttaaccaaattagttctagagactcagttaccatggaccaaatgtcttcctatttattgccctgttaagaatccaaactgcacctcagaaggatataggcctttctccttatgaaatgccctatggactgccctatttacactccactacctatatccctacgtttgagacaaaagatcaattcctcaggaattacatatttggtctctcctttaccttctcttctcttaaagccaaaggtctcatggtacaggcaccactcctagagttcctggtccattagcatcagcccagggatcatatcctcatcaaaagctggaaagaatgcaaacttgagccagcctgggaaggaccctatctagtgctcctgaccactgaactgcagtccggacagcagagacttgacacttgagtcaagaaagcaccgtccaccccgaagtcatgggccattattccaggggaaaaccccctcaaactaaagctaagaaaaatttaactctcttccattcttcttttcaccttccaatgctgaccaccttgttattaattaactaaatcaaacacaccccaagttattacatttgacgcttgtctagtcataccctgtagagatctccaaagtcagaggcaactctcagcctcagaaaagtatctctgcccctttaaagtgaaaggcgccccctaccaagactcttgttccttaacaaatgtaggaaaacaagtctgtcatagctggaatgatgtcctgtggaaaaccgaatatcaaggctggacctcatcagcgagtggttgtatatccttaaaaccatatattcgttttactaaggagagcacctcccccagttgccagtgtaaccaatgtaatcccatatacatttctattctcattcccacctctactgatcctaaacctactttaagtcgcttctataacataggagccaacttggctgcacagacctcatagggtcttttgaaatgcgttttattaatccttcattctcttcacccccttccttctcttctccttctgagctttcttctaatcagactgccatctcttctatacctaatgataatactaaagtagatattgtagcagtagatggtctaaggcaaactttagaaattgaaacaggatatcaagatgtaaacgcctggttggaatggatcaaatattctgtctcacattaaataaaagcaattgttatgctcgtgcacatggctggccagaggcccagatcatcccctttccactcagatggtctcccagtcaactgggcatgggctgcatggtagctcttttctaagattccatggcttggggcaacaaattgtggcaagctctctctctgctatatcccaaagtgcaacaccctgtgggtcagcccccaagggccattcagcttcggtcttctgctcatttcacctcgtgtctctcatgacagggggagaacttagtgttccttggcagcttagcaggacgcagtgagcttaagcctttgcaggagcttacccatcagtcgccccttagtcatcctcaagcagatgtatggtggtgttatggtggacccttactggacactctgccaggtaactggagcggtacttgtgctcttgtccaattggctatccctttcaccctggcagttcatcaaccagaaaaagaaaaaacacaacgccacaaaataaaagaagccccttatgggtcttttgactctgacgtttatttagatgcaattggagtcccacagggggtacctgatagattcaaagcctgagatcaaatagctgcaggatttgaatcattatttccatgggtaactattaataaaaatgtagattggataaattatatctactataatcagcaatgatttattaattacactagaaatgctgtcaaaggaatagttgagcaattaggacctactagccaaatggcttgggaaaacagaatggccctagacatgacgttagctgaaaaaggtggagtttgtattatgatcaaaacccaatgttgtacctttatcccaaacaatactgcccccgacagaagcataacaaaggccttacagagactgactgctttgtccaatgaactagctaaaaattctggaattgatagccctctttcaggatggctagaaagatgatttggtaaatggaaaggagtcatggccccaatcttcacttctcttgcagtcatgataggtgtgcttattcttgttaggtgttgcatcataccatgcatccgtgggctagtacaaaagcttataaagacaacactcactaaaacctcccttagttctcctccaccctattcagataagcttttccttttagaagaccaagttgaacagcaaagccagaacatgttaaaaaggtctgaagagaaaagattataaaaatttaaaagggaggaattgtaagatacaatgaatctttctgagtttcttttcaaaaggtttagcctgttaacttccttaccctttgttctccaacttaactttcttgtttctccttgccaacagttactgtaaacagcctacccccttcccgtcagttctaatcaataactcacatctgttcccttggttacctgtacccatcgttcccttgaaactgcacgtctcacaagctccaccactgtacctcacgtccccctcctttccatatttagaaaaatatttacaagtagccaatcagatgagctcagattttgcagtctgaccccagcccatgggggaaggacacagagatagggatcgcgttaaggatataaaaaccccctggtgtcctttgttcagtgtgcacttgtgaccttgtttgacacaagtggcacccttttgcaaaagaaaattgccttgatgaggaaactaaatttatattcgagtgctgtttcttttgcggcatcggaaattcatttataataagttcaacttaatatttttgtggtggaaaaacatttatctgaaatgtacaattaattttaatttgattttgattttccttttattaagttggctaaatatatacttaaaatatatattatggagtgcataaacctatttttgtacaatttttatcatgttccttcaatctgttcattctactaaatatatattcttctatgtttacttatgatataaacagtgatgtttaaaatgattctcacttgggaggagccaagatggccgaataggaacagctccggtctacagctcccagcgtgagcgacgcagaagacgggtgatttctgcatttccatctgaggtaccgggttcatctcactagggagtgccagacagtgggcgcaggtcagtgggtgcgcgcactgtgcgcgagccgaagcagggcgaggcattgcctcactcgggaagcacaaggggtcagggagttccctttcctagtcaaagaaaggggtgacagacagcacctggaaaatgggtcactcccacccgaatactgcgcttttccaacgggcttaaaaaacggcgcaccaggagattatatcccgcacatggctcggagggtcctacacccacagaatctcgctgattgctagcacagcagtctgagatcaaactgcaaggtggcagcgaggctgggggaggggtgcccgccattgcccaggcttgcttaggtaaacaaagcagcccagaagctcgaactgggtggagcccaccacagctcaagaaggcctgcctgcctctgtaggctccacctctgggggcagggcacagacaaacaaaaagacagcagtaacctctgcagacttaaatgtccctgtctggcagctttgaagagagcagtggttctcccagcacacagctggagatctgagaacgggcagactgcctcctcaagtgggtccctgacccctgacccccaagcagcctaactgggaggcaccccccagcaggggcagactgacacctcacacggccgggtactccaacagacctgcagctgagggtcctgtctgttacaaggaaaactaacaaacagaaaggacatccacaccaaaaacccatctgtacatcaccatcatcaaacagagcagaaaaattggaaactctaaaaagcagagtgcctctcctcctccaaaggaatgcagttcctcaccagcaacggaacaaagctggatggagaatgactttgacgagctgagagaagaaggcttcagacaatcaaattactccgcgctacgggagaacattcaaaccaaaggcaaagaagttgaaaactttgaaaaaaatttagaagaatgtataactagaataaccaatacagagaagtgcttaaaggagctgatggagctgaaaaccaaggctcgaagagaactatgtgaagaatgcagaagcctcaggagccgatgcaatcaactggaagaaagggtatcagtgatggaagatgaaatgaataaaatgaagtgagaagggaagtttagagaaaaaagaataaaaagaaacgagcaaagcctccaagaaatatgggactatgtgaaaagaccaaatctacgtctgactggtgtacctgaaagtgacggggagaacggaaccaagttggaaaacaccctgcaggatattatccaggagaacttccccaacctagcaaggcaggccaacattcagattcaggaaatatagagaacgccacaaagatattcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggtagaaactctacaagccagaagagagtgggggccaatattcaacattcttaaagaaaagaattttcaacccagaatttcatatccagccaaactaagcttcataagtgaaggagaaataaaacactttacagaaaagcaaatgttgagaaattttatcaccaccaggcctgccctaaaagagctcctgaaggaagcgctaaacatggaaaggaacaaccggtaccagctgctgcaaaatcatgctaaaatgtaaagaccatcgagactaggaagaaactgcatcaactaacgagcaaaataaccagccaacatcataatgacaggaacaaattcacacataacaatattaactttaaatgtaaatggactaaatgctccaattaaaagacacacacagactggcaaattggatcaagagtcaaaacccatcagtgtgctgtattcaggaagcccatctcacgtgcagagacacacataggctcaaaataaaaggatagaggaagatctaccaagcaaatggaaaacaaaaaaaggcagggattgcaatcctagtctctgataaaacagactttaaaccaacaaagatcaaaagagacaaagaaggccattacataatggtaaagggatcaattcaacaagaagagctaactatcctaaatatatatgcacccaatacaggagcaagcagattcataaagcaagtcctgagtgacctacaaagagacttagactcccacacattaataatgggagactttaacaccccactgtcaacaatagacagatcaacgagacagaaagtcaacaaggatacccaggaattgaactcagctctgcaccaagcagacctaatagacatctacagaactctctaccccaaatcaacagaatatacatttttttcagcaccacaccacatctattccgaaattgaccacatacttggaagtaaagctctcctcagcaaatgtaaaagaacagaaattataacaaactatctctcagaccacagtgcaatgaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacacaacataccagaatctctgggacacatccaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaaatgaaggaaatagagacacaaaaaacccttcaaaaaattaatgaatccaggagctggttttttggaaggatcaacaaaattgataaaccactagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctacaagaaatggataaattcctcgacacatacactctcccaagactaaaccaggaagaagttgaatctctgaatagaccaataacaggatctgaaattgtggcaataatcaatagcttatcaaccaaaaagagtccaggaccagatggattcacagccgaattctaccagaggtacaaggaggaactggtaccattccttctgaaactactccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaacagaatccagcagcacatcaaaaagcttatccaccatgatcaagtgggcttcatccctgggatgcaaggctggttcaatatgtgcaaatcaataaatgtaatccagcatataaacagaaccaaagacaaaaaccacatgattatctcaatagatgcagaaaaagcctttgacaaaatccaacaacccttcatgctaaaaactctcaataaattaggcattgatgggacatatttcaaaataataagagctatctatgacaaacccacagccaatatcatactgaatgggcaaaaactggaagcattccctttgaaaactggcacaagacagggattctgtcaccactcctgttcaacatagtgttggaagtcctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaatgtctcaggatacaaaatcaatgtacaaaaatcacaagcattcttctacaccaataacagacaaacagagagccaaatcatgagtgaactcccattcacaattgcttcaaagagaataaaatacctaggaatcaaacttacaagggatgtgaaggacctcttcaaggagaactacaaaccactgctcaatgaaataaaagaggatacaaacaaatggaagaactttccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccagaaaagagcccgcatcgccaagtcaatcctaagccaaaagaacaaagctggaggcatcatactacctgacttcaaactgtactacaaggctacagtaaccaaaacagcatggtactggtaccaaaacagagatatatatcaatggaacagaacagagccctcagaaataacgccgcatatctacagctatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaactttagaccaaaaaccataaaaaccctagaagaaaacctaggcattaccattgaggacacaggcatgggcaaggacttcatgtctaaaacaccaaaagcaatggcaacaacagccaaaattgacaaacgggatctaattaaagtaaacagcttctgcacagcaaaaaaaaaaaaactaccatcagagtgaacaggtaacctataaaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctagagaggatgtggagaaataggaacacttttacactgttggtgggactgtaaactagttcaaccattgtggaagtcagtgtggcgattcctcagtgatctagaactagaaataccatttgacccagccatcccattactgggtatatacccaaaggactataaatcatgctgctataaagacacatgcacatgtatgtttattgcagcattattcacaatagcaaagacttggaaccaacccaaatgtccaacaatgatagactggattaagaaaatgtggcacatacacaccatggaatactatgcagccataaaaaatgatgagttcatgtcctttgtagggacatggatgaaattggaaatcatcattctcagtaaactattgcaagaacaaaaaaccaaacaccacatattctcactcataggtgggaactgaacaatgagaacacatggacacaggaaggggaacatcacactctgcggactgttgtggggtgggggtagggggagcgatagcattgggcaatatacctaatgctagatgatgagttagtgggtgcagcgcgccagcatggcacatgtatgcagaggtaccagcatggcacattgtgcacaggtaccctaaaacttaaagtataataataataaataaataaataagtaaaaaatgattctcactaaatgttaataatggttattttaagagtagttagaatttgtggtgggtttttatttctttttttgtaattttgtattgctttaatttttcaaaacaaagatgtataatttatagaacaatagcaaagtcgttactccaagatcaataaaggaagagaccactaacaggaaaaacaacggaaaagcaagtgtggaatatatgggaccaaagaattttctagcctgtctcctgtatctgcagctggcttctttcaaactgtgtgagtgcctttataatgcaaataaaaggattaattcccctgatgttttgctactgagccagacctttacatgttcaagaatatggtcactatattgctgactatgtccacttaagttggaaataaaatgcgcaagtataatttttcaagatgtggtttgccaactagcagcactggcatcacctgggtatttgttagatatgcagaatcttaccttacctgacatactcaatcagaattttcatggtgacaagatcccctgaatgatctgtataaacatttaagcttgaaaagcactgctttaaaagatctaatggctcaattttccaataaggatattgaacagcggcttacataaagctacagagattaatcctatagtgggtttgcagaaaggagaaaaaaagattttttccgtgcacatgaaattattcattccacaatttagctgtgttttataggctatggggtccatctttggtgtggctgggcatccacacatttttaaacatattcagagtgatatcggggatttccaggaaaacagacacaacggttgatggttaaagaagaaaaaggaaagctttcttgtttgctggcttgttttgttagcgcaagatatgaagaatccggctgagggcagagttaattagcattatctaaagtgaaaaaaaaaataggattacctgcaagagatctcagcacttgtaattctttttccaaattgtctaaagtatgttgatcagtagtgtcatctaaggaaagctcattctggtcagtaatatcaatatattcaatttctgaaatttcagaagcagctctagatgatgattgagcagctgcacttcttgatcgaggatgagaggatgaaaggcaactggagctttctttaacagagttggaaagtggaaaatttgctgttgaaggtctctgtgatttctgacctaaaattaaaagtaaaaagtttttaaatcaacttttaaaaatttgaatgagtacttaaagatacaaaataccaggtccctgcacacagagaagttaagttcatgtaacagagtttatgaaaagttaactttgactatcaccctttctagctaaccacattttcttaatctcaaattacttttccaatgtcataaagaacacttctgtgtatttttttcctaattttcctacattcagaggaaaacaaactaattttaatattcacaaaggaaaatatctataaactaagtcaactttgtagagaaacaacacacaattttataacgtattccaaagccaagcaccacgacatgtgtcttaaattccaggacaataccaaacttaataccttgtaagaaaaaaaaccttagaaaaagcatcgtgccacttcctagtaaaccaattttacttgatgatatgtaatttattcttacatttaaaaatatggcaacaaaagagactaatttacaaaatctatatgaatatttggaaaaacacaggctttaaagaaattgagatcacgtctctaattttcctacggatgagctcactctcttctggaaaagttccagaagcaccgatctaaattaggttattacattgttcctctaggacagtcgctactttgtcttcacctgttttgaaagttgacttagttggtttcttcaacatgtttgctcctttaacagtaggaaaaaaaaatctcttcaaatcttatactaacacaacataactaatttctaatttggtatttctcacaaaatattacttaataaggccaagacagttttcaaggtacatatttaaaaattcatagggcaggtaaatgctttaatgtaataaattattgttctgatttaggtaaatatatttatagtaaacataattatattataagataactttgcactcccttaacacaaactggctttgtaaaactattaggtgggtgcaattgtcattatcataaaaaccctaatttgatggaacctatgccatataacattgttctcactctagtgactcaacaaaaaatataaaattcaaaaaagtgactacaggcggtaatcatgtattaaatatttaatgactattgagttgtttttggggggttttgggagtttttttggagaaggagtcttgctctgtcactaggctggagtgcagtggcacgatctcggctcactgcaacctttgcctcccaggttcaagcgattctcctgccccaggctcccaagctgggattacaggcgcgtgccaccacacccagctaatttttgtatttttagtagagatggggtttcaccatgttggccaggatggtcttgatctccagacttcatgatccgcctgcctcagcctaccaaagtggagtttgtctttttttaacttaaaaaaaatctacttcgaatgtgtctaatacctcaagaagactctcaatacagtatgtaattatttaagcaattaaaattggccaaggtaagtctcaaagggtaccaactttagtgaaaatttcagaaatcaatttttaaaataattttaattgaaataaaattatgagtaagttaaaataagactgatcttttgtgtctatttgtgctcagataaaaataatgggctaaaatatgcctaagtgttaaaaacatatatctatatctatatatatatataattatccctgagaattatttttatgactataagttagaaatgatttcctcttttatctataatatgtaaagaaccatatttatagcaatcaagaaccaaactctccaagtctacataaggaagcaatagcacaggcaatagcagtagctgcacaagtcagagagtgtaacaataattcgcaatataaatcaaaagttctactctatggggtaaaccacactttagtatctgtactatgatatgtctcaatcaaggtaaaatttaaaggaattcacaactctttaaaaaaacaaaccaaacgaaaatactatgagtaaggactggacttctgccaattcacagaaatgaagaaagaaaaatttaatataatgtagatgcccttcagaaaatctagaagagtacgaacactaataagaacatttgattgccacagtatttaaaggtaattgatccccattgagaaaaagtacacaaaggacaggtcagacttatgcttagcacacagcaaagaaacagaccatctttcttactggaaatatgctcaaagtgtaatttaaagtaactaaaacacagaaacagacagaagaggccccagtttgattcttgattttgtttattgttcttttaagccaatatatcattctttctaatgtttaatatataagggtactaatgttacggttaagtttaagatataacacaacattaacactggcactagttaaaaatgccatgattgaggggatcattccatattttttttaaaaaaaatctcaatttgtagattaaaagcataagaagttacttttggagtaacatgcgccatcactgtcaatgtaatcataagaaattattggttaacactgatcagttatattctaaatgtaacaaaataaattttccttggtgttaactgaagaatatatgctctatgattactaataaaactaagccaactattgggaagataaaattcaatagtgactttaaatcatattaatggatacaatattactggtaaggatataaaaaataggaataattcactgaatgataatcgttattgctattctaaatataacaatagaattagatgaaatgtaactatagcaacataattttaggtagcgttttaataacaaataatattcttatcaaaggacccagtattttgatcttaaataaagtttgcaaaacactgttgtctattgacattcatgtttcactgtatcaactgctgagaatttatacataaaaagaattcttagaaatgtattttctaagaattcttaaatttatatacaaattttatttagcagcatggttaagtggaaagaatactaaactaggtaactaagaatgttattgtgttatcttatagaattagaaaacagcttatgacctgtgaaatacaaaattcaggaactggatagtagaacgtcttaaattccttccaactctgagagcttgtgaattaatactcaatcaaattcaattataaaattatttatcaccctctaaaactgccaggcactgtgtcaggattggggtattcaaaagggaataagacatcacctccaccctcaagttgcactccaaactaacacacagttctactagcctactctactaattggaaaacacttactgagcacttacaataggccaggccctgttccattactgaagataccccaatgaacaggacagactagtccttgatttctttccaaccaagggtaagagaaagcaggaaaaaagctaataagatgatgttaaatagtgatagcttttacaagaaaaataaaagaaggtaaatgtgatagaggaactcaagagaccagcactagatagggtggtgccagaaggtctctctatggaggtagcatctggactgaagctgaataatggaaaagaatcaatcatatgaagagtgtgagaatggagagggaaatttcagagcatcctggagaagaggtaagatctaattctaaggctaagaagtgagtaagagagtggcttaagaacagaaagaaagtaaatgtggctacagtgtaggagaagatgcagttaggagagacgggtagccaaccaaggtgttgctgtgtgatacatggtaaggcatacttttttctactttctatagggatccatggaatgctttagacaatagaatggcatgatacaatatatggtttacatttatggaaagtacgattcacttcctataaactataaatatcaatactgttatgagtaaaaacaattcactcactgactataaatagtagaatataatggaaatgaattatagcaacatgattttgggagaagtaaaagtgaaaatgggagacaaatgagagatgaagacaaatggcttggactaatcttgaatagtgaaggtaaaagtgtttagtgttgggcttgattttagagctgaaatcagcagaatctaaaaataaataggatacactgagtgagaggcaagatgactcccaaatttcagacttaatcaatgtttggatacagttgccatttccagaggcaggaagatgggctaggggaggattaagttgtggcagggatgagaagaatgaataaacttgctgctaaacacacatagctacgatgtttttacattcatgacttcttaattgttatggaaatgggaattcctctatatactggcatcagtgcagaatacaagatttctataacttgtgacagagccaggcaatttttagtttattttagaccattgtctctgttcagaaagccatttcctaccttctctaactggtaaatattataactttttaaagactcaactgaatgttacctagtctctaatatcttgccaatctacacttttcaatagcaaagtcattatgttatcatctctatttctaaaaaaaaaccttgcttatatatctaactattatagctgataggacatattatcattaattacctattaaggtccaaaagtaaattactcataggtctttttataaaacttatatgtggtataatttacatattcacacacacattttatatatatcaaaaaatttatagcacttttctcaaaatatggtattcagactgtttatattagcataacacggagttgttgttgttcagaaaataaatgcaatttcttaggcattacctcagccttaattaatcagaatccctaagagtcagatccagaaatctgcattgcaagaggtttcccaggtgattatgcccacagcgacttttgagaaaattttatactggactctaagctcttaagcaatagagataagagtttgttttgtataaacagtgtctggcagtagtgcttgaacaaatgttttttatagcaaattattgattttgactgatctgtccaaattgatacttaaaagcatttgactatggatttgtagatttgtctttgtaataaatttctcatagcacgtatatgaatttgttttcatcaatatacagtgacttaaagcagttctttctgattgcctcagagggaagcaaccagaatttttgaagttgctgtcgactttgatgtaaaaataggcatctaagtatagagccaaaaaaatcataaatacattgttttctccctaaaaattttatatctgacagattctcaacataaatgcacatggaaaggatctaagatagccagagagttttaatcatagattttagggcaagagagacatatatatcttatatagagaggcaaatcatatgcaattaaatttctgccttgaagatagcctttaaaccaaggcaaatagccccctttctcaggtattcctcctaaactgtgagctcaataagatcagggaatattacttacatatctcttttatcctcggggccaatccaagtgctaatatcctcaaaatatatgctgaattacctgaattcattagttgtctactacaacttcctactttggcatagagcaaacccactatagctggtataatgggataacagtaatgtcctaataatagtagtgattttaatgatgttatatgctctgtatacactcattaggaaagtatcaaaatagatattcagtatgtcaaaagaattattctatggaaaatcttataattactttgtttagagaatagaggtaatgaactgaaatgaagattccagggtcaatgcatacagaattatatttagaactaagctttctcaatcccagcaagaaacagcatcttaacctaagtcaatcatttcacatatggctctgtctgatcataatatatatcaagtgaaagagtatgcaaaatctggtataaacatactgcttcctgagtgagtaatgaaaccatgtattttataaggattgttcaaaatatgccatatccttaactacattttgcaaatattatttcctaatacattgttatagaaaataactaagatgataattcatgcctttggaaaaatgagctcacttgtttttatgctttggttttggaagaaaagtcgaggacatttagttaaaatgaatgaatttaaattacagaacttcaaaaactaaattgcaggtgcctactaaactgctaaaaaagcaaactactaaaggaagtaagctgccaacatggcactgctgcctttgagtcaatgttacccatcttttgctgttttctacttgatgatggactctgagcaccctgcagaacacccaagacaattgcattatcagcatattcacttaagctatggtctggaatccattctctgtcttctgaaattgaaaaacagtaagataacataaagtttgaaaagaagaaaatccattttattagttttatatttatgtcttactggacaatatttaactgaataaagaatatttacaacagtgatatatattatgaaatacaaaatcttattacaaaataaaaatcattaaattaatatattttaattttaaaaatttaaaaagtatataacaatgcaacataaagtataattgtttctacatgaataaacacatttgaatacataagatgcctaagaatatagatgacaccaagatctagctttcaaaatggaaactaaaaaatcatgaagagaagatggccaaataggaacagctccagtctgcagctcccagtgataatgatgtagaaggcaggtgatttctgcatttccaactgaggtacatctcattgggactggttcatctcattgggactggttgtacagtgggtgcagcccaaggagggcaagccaaagcagggtgtggtgtcaccttacccaggaaggaaaggaactccctctcctagccaagggaagccattagggactgtaacttgcactctggctcggatactgtgcttttcccgtggtcttcgcaaccctcagaccaggagatcccctccggtgcctacaccaccagggaccttggtttccagcacgaaactgggtggccacttgagcagacaccgagctagccacaggagtttatttctcatacccgagtggcacctggaacatgagtgagacagaagccaggggggtgaagccagggagccaagtggtctggctcatcggttcccaccctcatggagtccagcaagctaagatccactggctggaaagtctcactgccagcacagcagtctgagctcaacctgggatgctcgagcttggtgaagggagaggtgtctgccattactgaggcttgagagggtggttttatcctcacagtgtaaacaaagctgctgggaagttcaaactgggcagagtccactacagctcagcaaagccaccatggccagattgccttctcaagagtccctccctgaaaaaaaggcagaagccccagccacagacttatagataaaacctctacctccccgggacagagcacctaggggaaggggcggttgtaggtgcagcttcagcagacttaaacatccctgcctggcagctctgaagagaacagcagatctcccagcacagcgtctgagctctgataaggatcagactgcctcctcaagtgtatcctgattgggagacaactcccagcagaggccgacagacacctcttacaggagagctctggctggcatctggtgggtgcctcactgggacaaagcttccagaggaaggaacaggcagcaatctttgctgttctgcagcctccgctggtgatacccaggcaaacagggtctagagtggaactccagcaaacaccagcagacatgcagcagaggagctggactgttagaaggaaaactaacaaacagaaaggaatagtaacaacatcaacaaaaaaaacatccactcagagaccccatctgaaggtcatcgacttcaaagaccaaaggtagataaattcacgaagatggggagaaaccagtgcagaagggctgaaaattccaaaaacctgaatgcctcctctcctccaaaggatcacaactcctcaccaccaagggaacaaaactggacggagaatgagtttgacgaattgacagaagtaggcttcagaaggtgggtaataacaaactcctctgagctaaaggaccaagttctaacccaatgcaaggaagctaagaaccttgagaaaaggttagtcaaattgctaactggaataaatagtttagagaagaacataaatgacctgctggagcagaaaaacacagcacaagaacttcatgaagcatacacaagtgtcaatagctgaatagatcaagcggaagaaagtatatcagagattaaagatcaactcaatgaaataaagcggaaagacaaggttagagaaaaaagagtgaaagaaacgaacaaagcctccaagaaatatgggactgtgtgaaaagaccaaatctacgttttattggtgtacctcaaagtgacggggagaatggaaccaagttgggaaacactcttcaggatattatccaagagaacttccccaacctaccaagacaggccaacattcaaattcaggaaacacagagaacaccaaaaagatattcctttagaagagcaaccccatgacacataatcctcagattcaccaaggtttaaatgaaggaaaaaatgttaagggcagccagagagaaaggttgggttaccgacaaagggaggcccatcagactaacagcagatctctcagcagataccctacaagcagaagagagtggggatcaatattcacatacttaaagaaaagaattttcaacccagaattttacatccagccaaactaagcttcataagcaaaagagaaataaaatcatttacagacaagcaaatgctgagagatcttgtcaccaccaggcctgccttacaagagcttctgaaggaagcactaaatatggaaaggaacaaatggtaccagacactgcaaaaacctaccaaattgtaaagaccattgacactatgaagaaactgcatccactaacgggcaaaataaacagctagcatcataatggcaggatcacattcacacataacaatattaaccttaaatgtaaatgggctaaatgccccaattaaaagacacagactcacaaattggataaagattcaagacccatcagtgtgctgtattcaggagacccatctcacgtgcaaagacacacataggctcaaaacgaaagaaagcaggaaattttaccaaccaaatggaaagcagaaaaaaagcaggggttgcaatcctagtctgtaataaaacagactttaaaccaacaaagatcaaaagagacgaagaagccattacataatggtaaagggatcaatgcaacaagaagagttaactatcctaaatatgtatgcacccaacacaggagcacccagattcataaagcaagttcttggagactacaaagagatgtagactcctatacaataatagtgggagactttaacaccccactatcaatattagacagatcaatgagacagaaaattaacaaggatatccaggacttgaactcagctctggaccaagtggacttaatagacatctacagaactctccaccccaaatcaacaggatatacattcttcccagcatcacatcacacttattctaaaattgaccacataattggaagtaaaaccctcctcagcaaatgcaaaagaatgaaaagcataacagtctctcagaccacagtgcaatcaaattaggaatcaggattaagaaactcactcaaaactgcacgactacatgaaaactgaacaacctgctcctgaatgactctgggtaaataacaaaatgaaggcagtaatgaagatgttctttgaaaccaatgagaacaaagacataatgtaccagaatctctgggacacatttaatgcagtgtgtagagggaaatatatagtactaaatgtcctcaagagaaagctggaaagatctaaaattgacatgctaacatcacaattaaaagaattagaaaagcaagagcaaacaaatgcaaaagctagcagaagacaagaaataactaagatcagagcagaactgaaggaaatagagacacaaaaaacccttcaaaaaaccaatgaatccaggagctgtttatttgaaaagaccaacaaagtagatagaccactagccaaactaataaagaagaaaagagagaagaatcaaatagatgcaataaaaatggcaaaggggatatcaccaccgatcccacagacatacaaactaccatcagagaatactataaacacctctatgcaaataaagtagaaaatctagaagaaatggataaattcctggacacatacaccctcccaagattaaaccaggaagaagttgaatccctgaatagaccaaaaacaaattctgaaattgaggcagcaattaatagcctaccaaccaaaaaaagtccaggaccagatgtattcatagccgaattctaccagaggtacaaagaggagctggtaccattccttctgaaactattccaaacaatagaaaaagagggacgcctccctaacctattgtatgaggccagcatcatcctgataccaaaacctggcagagacaaaacaaaaaaagaaaatttcaggccaatatccctgatgaatatctatgcgaaaatcctcaataatactggcaaaccaaatccagtagcacatcaaaaagtttatccacaatcaagtcggcttcatccctggatgcaaggctggttcaacaaacgcaaatcaataaatgtaatccatcacataaacagaacaaatgacaaaaaacatatgattatcttaacagatgcagaaaaggccttcaacaaaattcaacagcacttcatgctaaaatctctcaataaaactagctattgatgaaacatatctcaaaataataagagatatttatgacaaacccacagccaatatcatatggaatgggcaaaacctggaaacattccctttgaaaaccagcaaaagacaaggatgccctctgtcatcactcctattcaacatagtattggaagttctggccagggcaatcaggcaagagaaagaaattaagagtattcaattaggaaaagaggaagtcaaattgtctctgtttgcagatgacatgattgtatatttagaaaaccccattgtctcagcccaaacctccttaagctgataagcaacttcagcaaagtctcaggatacaaaatcaatgtgcaaaaatcacaagcattcctatacacctataacagacaaacagagagccaaataaagagtgagctcccattcacaattactacaaagagaataaaatacctaggaatacaagttacaagggatgtgaagaacctcttcaaggagaactacaaaccactgctcaaggaaataagagaggacacaaacaaatggaaaaacatttcatgctcatggattggaagaatcaatatcatgaaaattgtcctactgctgaaagtaatttatagattcaatcctatccccatcaagttaacattaacttcttcacaggattggaaaaaatttactttaaatttcatatggaaacaaaaaagagcccgcatggccaagacaaccctaagcaaaaagaacaaagctggaggcatcacactacttcactttaaagtatactacaaggctacagtaacccaaaacagcattgtactggtaccaaaacagatatatagaccaatggaacagaacagagccctcagaaattatgccacacatctatagccatctgatctttgacagacatggcaaaaacaactaaaagaaaaggactccctatttaataaatggtgttgggaaaactggctagccataggcataaaactgaaactggatcccttccttacaccttatacaaaaattaactcaagataggttaaagatttaaatgtaagaacgaaaaccataaaaaccctagaagaaaacctggcaataccattcaggacataggcatgggcaaaggcttcatgactaaaacacgaaaagcaatggcaacaaaagccaaaatagacaaatgggatctaattaaactaaagggcttctgcacagcaaaagaaactatcatcagagtgaacagacaacctacagaatggaagaaaattttggcaatccatccattggacaaagggctaatattcagaatctaaaaggaacttaaatttacaagaaaaaaacaaacaaccccatccaaaagtaggcaaaggatatgacagacacttctcaaaagaagacatttatgcagccaacaaacaaacaaacaaaaagctcatcatcactggtcattagagaaatgcatatcaaaaccacaatgagataccatcttacgccagttagaatggtgatcattaaaaattcaggaaacaacagatgctggagaggatgtggagaaagaggaatccttttacactgttggtgggagtgtaaattagttcaaccattgtggaaaacagtgtggtaattcctcaaggatctagaactagaaataccatttgacccagcaatcccattactgggtatatacctaaaggattataaatcattatattataaagacacatgcacacatatgtttattgcagcactgttcacaatagcagacttggaagcaacccaaatgcccatcaatgatagactggataaagaaagtgtggtacatatacaccatggaatattatatagccataaaaaaggatgagttcatgtcctttgcagagacatggatgacactggaaaccatcattctcagcaaactatcacaagaacagaaaaccaaacaccacatgttcccactcataagtgggagttgaacaatgagaacacatggacacatcaaacactggggcctgttggggggtggtgggataagggagggatagcattaggagaaatccctaatgtagtgatgggttgatggatgcagcaaaccaccatggcacgtgtatacctatgtaacaaacctgcatgttctgcatatgtacccagaacttaaagtgaaattttaaaaaaaaatcatgaagaaacaaaaaattggaatatatatatatatatatatatatatatatatatatatatatatatataaaaaaaactagtaaggagattaaatctgttaacaaaaatttgccaataatgaaaagtcctggacctaattgcattagtggtgagttctatcacacatttgaagaaataacaccagtcctcaaacttttccaaaagattgaagaggagggacatcaactcgttgatactaatgccaaataaagacactacaagtaaagaaaacatcagaacaatatcatttataatcagtgatgtaaaaatcttcaaagtacaagcaaaccaaattcggcagcatattaaaaacggttatacatcatgatcaaataaaatttatttctgaaatgtaaggatggttcggcatatgaaaatccatcagtgtaatacactacatttatagaatgaaagaaaaaaacacataatcatctcaatttatgcagaaaaagtatttgacaaaatccaacacacttttatgataagaacaaccaacaaactaggaataaaagggaaatgcctctacacaataaaagtaatatgctaataacccacagcaaacatcaaactcaatggtgaaaaatagaacatttctaagatctagagcaaggcaaggatgcctgcttttgctacttctattcaatataagtagccagaacagacaagaaaaagaaataaaagacatttgaattagaaaggaagaagtaaaattatctttgttcacagatggtgtgatcttatatgtagaaaacactaaagattccacaaaaatatgttagaataaatgaaatcagcaaagtagtaggatacaaagtcaataggcaaataccagttgtatttctatatgctaacaatgaacaatcggaaaaggaaattaaagaaacaattccattcacaacagcctaaaaaagaaacaaacttagaaatcaacataaccaaggaggtggaagacttatgcaatgaaaactataaaacattgctgaaagaaattaaagaagccacacataaaaagaaacatatctcatgttcatgaactggaagagttaatagtggtaaggtgccaatgttacccaaagtgatctacacattcaatataatccctatcaaaagctcaatgacatttttcgtagaaataaaaaaacccatcataaaattcacatgcaatcaccagggaccctgaatagccaaaacaatattaaaaacaagagcaaagctggaagactcacactttctgatttcaaaacttattacaaagatactgtaatcaaaacagtgtgataccagtaaaaagacagacatacagaccaatgaaatgggataaacaacccagaaatatatcctccctcacatatacaatcaaattataatgattttttaaaaagtatccttatggtataaaacttattttgaaatatgtatatattgtggaattgctaaatcaagttaattaacatatgtattatctcaccaatcatttttttgtgtgtgtggtgagaacacttaaaattcactctctcagccaaataatttttgacaagggtgcctagaccattcaatgggggaaagaaaggtcttttcaacaaatggtgctggaaaacttgatatccatacgcaaaataatgaatctggacctttgataccatgtacaaaaataaactcaaatcgatcaaagacctatatgtaaaacctaaaactacaaataccttagaagaaagtataggcccaggacattggctttggaaatgaattcttaaatatgacactgaaggaacaggcaagagcagccacaaaagtagacaaattggacttaataaaaactggaaaaaaactgcatccaaagacactatcaacagagtaaaagggcaatccacagaatgggaggaaatagttgcaaataatatatcttaagaagaagcagtatccagaatataataaggaactcctataactcaacaatgaaaaaacaaataacccaattaaaataagagctaaggaattgaatagacatttctccaaagagtatatacaaattacttattaagcacatgaaaagatgcttaacattattaatcattaggaaaatgcaaatctaagctacaatattgtaccacctcagacccatgaggatgactattctccccccgaccccaccaaaaaaataaaagaacaagtattgtcaagaatatgtaataatcggaacatttgtgccctgttggcagtaatgtaaaacaccaaccagatgctggcaccatactacttatacagcttgcagaactctaagccaaataaacttcttttatttataaattatgtagccttggttattcctttacagcaacactaaaaggtctaaaataaccacacttctaaatgctaaaaaatctttcctagtttcattgtaagtcatagtttctcacattctgatagtaaccttaaatgtaaatatatggcaactaatacaaggttaataattttaggctggcaagaagaaaatgattttatccattgaacagaattgctcagtatttcctaagatgagaacagactgttttagaaaaatgagctagaaatttacctgcaagtgtaatcctagtactggaattgttgcattctaaacgatgagaaggaagtaagttgagtctttcatttgtatcaaaaataaagaatctctcaagtccttgatattgttttgttataggcttacttctgcaggctatttcttgtaacaactaagaaacaaaatattcaacaatattattttctaactcattaacacaaacaagcatattcatttatcagatacctacttggtatctgatatacttggcacaaattcttccctcatcaagtttagtttctaacagtggagacaaataataaaacaacatttatatataggaagttctaactacagttacagtaattctctgaaagttgatactaatccaaagaggacagaagttcatgaaataaaataaactttttttctctttcttcctttattttcatccctcagtgtctttgcacataaattatcctggaatacagagttactttcacacgcagtggctttgaactagtgtctttgtctatatataaaataatttcaaaactgaaggtgaaataccaatgggaactatctgccctgacaatggtcatggaaaaaaaaatgtaagttaacaaaacactcatcatgaagcaaatataaagtaggaaactgtggcaagaggaagataagtaatttatgacgtttatatagctagaaactagcagacctaggctttgaatataggtctgcctgatttgaaacctagacttatcctgccaccctattaattcatttttacatgttcttattctaggattgaatataactgggattttaaaaaatgtgaatccagtagaaacagattaggaattcattagtaagagctctagatgaggttatagtataatcagagtagctatcagtttttaataattccgtaatgaatctaactaatgcccaaatatagtctgttcccataaatcaatgtaaagcaacttgctttaattttttataaatttataaattatataaatgagatcatattaaagaacaaagctagtgaccaataaagcatgtcattcaaagacaaatcgaaatcaaaattctcagcacatatcccctggccctcccagacaccaataaacaattacagaattctttccactctactgaagcttatatttgaattatgcaatcgcaaatctggaagagttttgaatgtcttggtttacagataaaaatcctaaaatagttatgttttgtctacttttagcacaaacttacaaagttaactattgatagttttagagccagaacaaaggacccctaactagtccattgttttcctaactactgccctacaaattagtacttaattccgtaggaagtactaccttacacagaaatcattttctgaaaactgaagtacaaaatgaacaattttatactcaatttggatggagcaccatagatttctaagtcatttcttctgatggaatggcttctactaggacagaaaaagagggaaataggttcaggtatagttcttaggaatgaaaagaaagtagattcaaccactttattcagaagcaggaactcagtctgcaaactgtgaagtaccaattatgatggccactttagaaagctctattttacagctcccctccacctgcttttcaccttttgttttgcaactcttcaaattctcttgtgatccaacaacttaattatttatagagattggccatctcctataataagatgctcagggagaacctttggcactcagcttaagtcctgtcttaccagtggtggaaaatttctgtgaaactatttacacttttttattcctcagatataattacctaggaatggattaaaacattattttatttataaaaggggcaatcctggagtcagaaacccattagtttgttgagaattcttttaaaatcctatgacagattattcctgaaaaaacttcaaatctctcaatccaatatcccccatgaggaaaaggcaagctttacctaacactattttattactgtccaggactacctttagtctcacctaattgaaaaaaaacaataaccatgtaagccattttacaacagtcactggtttttgattatgtcagcagctttgagctgctgagaactttatggatcctatgcacttaaacactcattcagattgtttcctgaactagctctgtcagaacatattttacactgagcaatattttatactgagcaatggatagtcttaaattgaataaaacaagaatgtataccagccacacacacattcccatctcccccaccaaccctttttttttttttttacgagataagagtctcaccctgtcacccaggctggagtgcaatggcgcgacctcagctcactataacctccgcctcccgggttcaatcgattctcctgcctcagcctcctgagtagttgggtagttgggattacaggcacctgccaccacgcccagctaatttttgtatttttaatagagacagggtttcaccatgttggccaggctggtcttgaactcctgaccttgtgatccacccacctcagcctcccaaagtgctgggattacaggcgtgagccactgtgcctggccttttttttttttttttttaacttttaagttcaggagtacttgtgcaggtctgttacataggtaaatttgtgtcatggagatttgttgtacagattatttcatcacctaggcattaagcctagtacctactagttattttttctaattctctctctcctcccactcatcaccctctgataagccccagtgtatgctgttcccctctatatgttcatgtcacacaccttccttttaagaaacatctaaacttagtgacacacctgttacattaattgaatagagtagtatgcattaacatataaaagaaggaaaggaaccctgctgtaaattattggtgctatgtaagtcacagctatcctgacagactctgatcagttgagagtagaccaggaattcaatgggatgcaaatcatcagactatctaactaaatgaaagattccctgagaaagtggattggataaataggcagggcctgagggcaatacatgtttccttatcctctcctactgaattgaagagaacggcaggaaagagttttcccagtgaattcctttgagtttattactgctttattacttttgagtcagattcatagttcattaatttttacttttttcttgcatttgggattataaatttcccagtaagtagtatttgagtttcatcctatacattatttacctgtgatgtttttgcttacattcagttctaaatatttctaccttctattttaattttttcattaacctggacatatttggacgggcgcagtggctcatgcctgtgatcccagcactttgggaggccaaggcggttggatcgcgaggtcaggagatcgagaccatcctggctaacacgatgaaaccccatctctactaaaaatacaaaacgttagccaggcgtactggtgggcgcctgtagtcccagctacacgggaggctgaggcaggagaatggcgggaacccgggaggcggagcttgctgtgagccacgatggcaccactgcaccccagcctgggcaacagagcaagactccgttaaaaaaaaaaaaaaaaaaaaaaaaacctagacatatttgaattgtattaattttgttagcattttgctatcgatttataatttattgtattatggttggaaaacaccgtgtgtaatatgatttctttagcatttgttgaaacttcctttgtggatttatttttgtaatgtgttgtaacatgtattttgtaaatgttccatgtgttcttacaaagaacacacattctctaattattgagtatgtggttcaaaatatgttctttaaacttatttgtattgatcaaatcttctctatctttactaatagaaaatcttattggattgatggatttgtcaataataccatgtggttttgtccatttttgctacaatatatctgaggctatattgataggtacatacaaattcagatttcctttaatctttctattaaatagttgattttatcatgtacataatggtcccctttaccctgataatgttttattaccttaaatttttttttaaattagtgcttgcctttactctgaaattcctccccccaccccatgttttaagcaggtttctggtaaaataactatacacacacacacactatccacatttattctaattacttatatgattgggtttattcccgtcagctttactctttctacttgctgtcaagaattgtgaagggtctgagattttatcctacgtgcaagcctgttatagtttcatggatgctggacgaagacacaagactccttggtcagagacaaatgactttatcactcacaacaatagcagttgccagagtatcatcatttgcaccaattcccagaacccagttttcacaggacatcatgaagagagccacgtgacatctgcacataccctgagctgtgttacaggagagaaatcctgatcttaggaaatccaattattttatactgggcagtaagcctgcctgacctttgccagaggaaaacattatttttattacaccagacagtaaacaaacctagtctttgctctgaagagggacataatctctatatttcaaggctgttatctatacaagcacccttgaaaatatactttggaacaaatagagtcagtggttttgctcaaaagatgtgcaaaaaaacatgagagacccaagaggaattgtacacccaatacttaactatactatttttcctttgatgcatttatttcctgactgttttaattaattggattttctatggtccccttttcctttagtattttggatgacatacattatgtctgtaacattttaattgttactcaaagtatttaacatgtataactaaaacactaagtcaacaatccctacaatgatctctaccttcctttataatacagaatcttagtacttttaactctaatcatacatatctaacagtcttacaagttatggtacatattatcctcattcaaatttcttcttttataattctcaaattgggcattctaataattattttgtaatacatctaatatatttgccattttcccctcacaccattatttcttgcatcctacttcttccttccaggtttaatttcttccttttttaagtatatcattcagatgttcattcaagaggcgaaataactaaattacctgaatttttctctaaacttgccattattttattcttggtcttgaatgaaagttttgcaagccttagaattctagattgttagtcagttctattggaagtttaaagataatgttccactgtgttacactgttgaggctatctgttgctgtgcatgagaatttaatgtcaatctagtaattgctctttggagataattatctgttgtcttttattgcttttaagattgtctatgaggtatctcaaaaataagtcataatgcgaatttgtttttatttatattgttcaggaattgtactttgttatttcacaatctgtcatattactaactcttcatatgtctttgctgcaatacaagcaattttttaaacttatcttccagggtaatatttctctccttatttgtatttaatatgctgtttatatccattttattataatttgaataaatatatttcgaatgttagaaatttttattggccttcataaatggagcagtccatactgtcttattcttaagttctttttatttcttcctttctatttttaaacattttaaatatagtctcacaggatagagattgagtctctctctctagagcaaagagcaggtttgtttactgtctagtgtaatgaagatagtcttcctctaggacaaaggtctggcaggcttactgcccagtgtaaaagatcgggtttcttaaggtcaggattcctcacttattacacagctcactgtttatatagatgtcacctggtactcttcatgttgccctgtggaaatctggaaattgaagttcttgttttctctgctgaaatgcatgctatgatcaatcgttttcttcactgggggaacgagaagataagcccatctgaagtggagctttattttgtggaatctattgtgggataaggtgtaagcatgtccttttataaagtattagtacttacttctgtcagatacatcaggatattaataggcacggattaacaataatgttaatgtcttggcttcaagtttccaagcaagaaatacatatgcaaatgtatatttgggtatgtatatccaaacctatgctaaatgaaagcccaagatatctattttccaggtgaaacgttttattggcctagcccagatcacttgcagagatcagtttcctttcatcttgttgcacctatgggtatgttcctagtgcactcctttaatgactgatcagacatttaggggtctaagtttttgcagaggactcagttccaatttcttatctcacaaaggtacaatatctgccacaaagtgggcacagaaagccaatcctccaagcagaagtagcagcaactcaagtattcatccttctgcttttttgcttccctcttcaggaaccataggaattcattttaaatgacttttaagcattgttaaaaatgtttgcctcacttaaatttcctaagaatgtattattaataattacaattagtaaagatttctagtatatagaatgaaattcaaatatagttttaaaacatggtaacaatgcaataatgagctactttacctttcctatgagaagaaacaaaatctacacctctatttccttattagccatcttcctgaaagaattaccttcttcatcttatacttacattaaaccacagtaactggttctgtctagatatctgcatttatttcattttgaccattgactatattatcggaaaaaactagaaagtatttattatactgtattattcataatgaatttcatttggaaaagttgttacttttccatgctcttactatgctgcataaggtgggccttaaagtatcatttatcacagaaagccatttattaaaatggcattcctcatattagaatttgtcctagaggccattaatgttctctcccgtatgagtcactcttcaactatctcataataatataaggcagcacattttaactttaataggaagtaacttgagaatgtattgtgtcactaagacattttcttatgaggtttcttataaaattttaatataataaacataatagagatttaccagtgatgactttgtagtttttgattcttcaaagcttggcctcttatacagattgctcaattccaaggattctttgatgtcttgagataatttctcctcaatgggagctttttctaaatctctacctagcaaagtgtccttgctttcaagtgatacacaggaatcatcagacttttgattactttctaaacctatatttttctcctttaaatttctttcaaaggaggtgctttcctcaattttttcaatgtcagaagaatacacatcaggatccacgatgttgtcaaaatctgtgtttgaagtttctgctgttaaaaacacacagttacaaaaggtacataaataaatttaaacaaataattaaactgttaataaaccaaaagttctgtggtaaaaaaactttctcaataaacactatttcacaaattcctttactgatgttttagtgttaaaatatttttactatgcttatattcataagtggtaatcataattcacttatagaaccaaacattaatgagctagactagtaaaagaaggtaatattttattttgcaatgaaatcttaaaattgatgcaaatttttatttcagcctgtggttcaattctcactttcccacctcctcctctcactcaaattttacaacagtaattcatgagaagtaacacagggggaacattttttcattttgccatttttccctagcatgcctagcaataaagagagggcacagggaaatgtgccagatgaaagaagagcagcagttgggggcacagaaaatgtgtagcagggacacctgcttctagaaagctacaaagtgaacaagattgtattagtcatctacctcattatgtctgctttaaataaatcatttggtttacatcaccggtttttaacctggttgcacagtagaatcatctgaaggcactctttaaaattgtcagtgtatgggcctgaccccaaaccaattaaatcagatcctgagagtggaactcaggcattggtcttttgaacttccccttgctaagttgtccaggtgattatagtgggtaacacagtagtgaaacactggtctagattttctgaaaaataaaaattctttgaatgtttataccatactactttcattttaaataaatgtacaccattatccagactgaatatagcttcttctggttatcccttactctgttccaaagacaaatatctctataagtagactatgtaaaatagtagaaactctgaataaaactgtctcctgtgatgtaaatgctttacagctttacaaaggacttgcttgttgcaatcaaatgtttatataactcaccaatttcagatagtatttagaactagtggaaacaaggaagtcaaaagtacctctctccataagacacacccacacaggtgcagaaaaggctttcgacaaaattcaacattcattcatgttaaaatctctcaataaactaggtattgaaggaatatatctcaaaataataagaaccatatataacaaacccagagccaacatcatactgaaagggcaaaagtattccccttgaaaactggcacaagacgaggatgccctctctcaccactcctattcaacataatattggaagtcctagcaagggcaaccaggaaagagaaagaaataaagggcatccaaatagtaggagaggaagtcaaactatctctgtttgcagactacatgatgctaaatccagaaaaccccatagcttaagcccagaagcttcttaagctgataactttggcaaagtctcagaatacaaaatcaatgtgcaaaatcactagcattcttatacaccaatgacagtcaagctgagagccaaaagagctccaatagctaaggcaatcctaagcaaaaagagcaaaactggaggcatcatgctacccaacttcaaactatactgaagagttaccaaaatagcatggtactggtacaaaaacagacacatagaccagtggaacagaatagaaaacccagaaaatagaccacacacctacagctatctgaccttcaacaaacctgacaaaaacaagcaatggggaaaggattccctattcaaaaaatgatggtgggataactggctagccatatgctgaagattgaagctggaccccttccttataccatatacaaaaattaactcaagatagattaaatacttaaatgtaaatcccaaaactatgaaaaccctggaagacaatctaggcaataacattcaggacatgggtataggcaaagatttcatgacaaagatgccaaaagcaatagcagcaaagcaaaaattgacaaataggatccaattaaactaaagagcttctgtacagtgaaagaaactatcaacagaataaacggacaaactacagaatgggggaaaacttttgcaaaccatgaattcaacagagctctaagaaccaccttctataaggaacttaaagaaatttgcaagaaaaaagcaatctcaataaaaagtgggcaaagacatgagcagacactttcctaaaagggacatacatgtgaccacaatcctataagaagaagctcaacatcactcatcattacagaaatgcaaatcaaaaccacaatgagataccatctcacaccagtcagaatggatattattaaaaagtaaaaaaaataacagatgctggtgaggttgtgcagagaaaggaacacttatacactgttggtaggaatgtaaattagttcaaccatcatggaagacagcatggtgattttcaaagacataaagacagaaataccattcaacccagcaatctcattactgggtatatacccaaaggaatataaatcattctattataaagatacatgtatatgtatgctcaatgcagcactatttataatagcacagacagggaatcaacccaaatgctcattaatgacagactggataaagaaaatgtggtacatatacaccatggaatactatgaagaaaaacaagatcatgtactttgcatggacatggatggagctggaggccattatccttagcaaactaacaaaagaacagaaaactaagcactagtttataatttataagaggaagctaaatggtgagaacacatggacactttagaggggaacaacacacactggggcctattgaagggtgagggtggtaggagggagaggagcaggaaaaatcactaatgggtgcaaggcttaataaatggatgatgaaataatatgtacaacaaacccccatgacacaagtttacctatgtaacaaaactacacgtgtgtccctgaacttaaaagttaaaaaaaggcatgcctaccagtgacatgtcagtttaccactgctatggcaacatctggaagttatcacctgtttccccagcaacaacctgatgacccagaagttgccaccccttttccagaaatttctgagtaactcatcttttaatttgcatgtaattaaaagtggctaaaaatattactgcagagccacctctgagatgctactctgggtacagtgcttatggggtaaatctgttccaaaaggaacactgcctttgccactgctgtacactgctactttaataaaacttgctgtctaacaccactggcttgcatggtgcaagctgtcagtggatctaccattctgtggtctggaggatggtggctctcttctcacagctgcactaggcagtgccccagtggttactctgtgtgggggctcctaccacatatttcccctttgcaccactctagtagaggttctccatgagtgctctgcctctgcaacagacttctacctggacatttaggcatttctgtacatcctctgatatctagacagaggtttccaaacctcaagtcttatcttctgtgactcacaggcccaacaccatgtggaagccaccaaggcttggggcttgcaccctctgaatccaaggtccaagctgtatcttggccccttttaaccctgactgcacttggagccactgggacagagtaccatgtcttgagggtgaacagagcagtgaggccctgagcctggcccatgaaaccatttttcccttctaggcctacaggccagtaatgggaggggatgctgtgaggatctcaggaatgccctagagacattttccccattgtcttggcaatcaatagttggttcctctttatttatacaaatttctgcagcatgtggctcgaatttctccccaaagaatgggtgtttcttttctaccacatggtcaggctgcaaattttccaaacttttatgctctgcttcccttttaaacataatttccagtttcataccatttctttgtgaatgcatatgactatatgctttttgaaacagccaggtcacatcttgaatgctttgttttgctgcttagaaattccttctgccagatgctgtaaatcatctctctgaagttcaaattccacagatgtctagtttgaggagggggccaaaatgctgccagtctctttgctaaagcatagcaaaagtgaccgttacttcagttcccaataagttcctcatttccatctgaaaccatctcagcctagacttcattgtccattatcactataagcattttggtcaaaatcattcaacaagtctctaggaagtcctaagctttcccacatcttcttttcttcttctgagccctccaaactgttctaacctctgcctgttaccgagttctaaagtcacttccacattttcaggtatctttacagcactacttcacttttctggtaccaattttctctgttagtccatttttaaactgctataaagaactacctaagactgggtactttattaaggaaagaggcttaattgactcacagttccacatggctgggaggtctcaggagtcttataatcatggcagaaggtgaaggggaagcaaggcatgtattacatgttggcgagggctggggatctgccacacacttttaaatcatcagagctcacgaggactcactcactatcatgagaacaacatggaggaaaccactcctatgatccaatcacctcccaccaggtccctcccttgacacatggggattacaatttgagatgagatttggttaggaacacagagccaagccatatcatagatagaaatctaaaaattatatacaagatctatatgaggaattctacaaattctgattaaagaaatcaaaattctaaataaatagagaaatattctatgttcatggatgggaagatttaatattgttaagatattttttcccaacttgatctatagattcattgcaatcccaatcaaaatccccgcctttttatagagaaacaaatgacccaggatagtgaacacaatatcgaagaagagcaaagtcagaagacttgatactaccttacatcaagattactataaatctataacaatcaagagagtgtgtggtattggaataaatgtagacaaatagataaatgaaacagaatagagaatcctgagtagacctatataaatacagtcaactgatctttgagagaagaataaaggcaatacaacaaagaaaatataatctgttaagcaaatgattctggaacaactggatatccacatgtgaaacaatatatatagacacagaccttacaccttcacaaaaattaactcaaaatagattacacacctgaatataaaatgcaaagctatgaatctctcaaaagataacataggataaaacatagatgacactggctatgacaataactttctagatacaacatcaaagaaaaaattgataagctaaactttattaaaataaaagcttatacactatgaaaaatagtccagagaataaacaggcaatccatacactgaaagaaaatatttggaaaagatatttgataaaagagtgttatgcaaaacatacaaaaaactcttaaacctcaacaataacaaaataaacaacccaatcaaaacattagctaaaaacctgaacagatattttaacaaagatatacagttggcaaataagcatattaaaagattctcgatatcatatgtcaacagagaattgcaaatcaaaaaaaaaatgaaatatcactacacaattgctagaatggaaaaattctgaaacactggcaccagatgatggtgaggatatggagtaacaggaactttcattaattgctggtgggaatgtaaaatagtacagctactttggtaagactgtttggcaattattaaaacaaaactaaacatacctgtaccatatgatccaatagttatgctccttggtatttacccaaataagttgaaaacttaagtcccaataaaaacccatacatgaatatttatagtagttttgttcataattgctaaagcttggaacaaccaaaatgttcttcaataggtgaattgataaataaactattgtacattcatacaattgaatattatttagcactaaaagaaatgagaaatcaagccacaaaaagacaaggagaaacctcaaatgcatattattaagttaaagaatccaattattaaaggctatgtactgtatgattctaactatatgacattctggaaaggcaaaactatgaggacagtaaaaaaaatcagtggttgccaggagttggtcagagagagggataaacaggtggggcacagagaatttttaggacgagaaggtattctgtatgatactataagtggtgaatatgtatcacattatacttttgtcaaaactcatagcatgtacaataccaagagtgaactctaatataaactatggacactgagttacaataatgtatcaaagtagattcatccattgtagtaaatgtaccagtctggttgcagaagctgataatgggggaggctatgtatgtgtatagagcaaagggtatataggaactctctgtactttctgctcagttttgctgtgaacctaaaactgctctaaaaagtaaacatttcaaaaatgtgtctttaaagtaacaattacatgggcatttatgtgcatcattttcttagaggcaacaggaacatcaggaactagcttgatcaaactatactcatcttcaggacaagattggaatactgtccctaaattcccatgtggctgtactttatatttggccataataatttagtggtttagtatttgaaaatgtcaagaccagcaggatttacacaaatctaccactgctttctatcttctgctgcccaatcagaatgtaatcatcagttttacaactatttatttcaaatatgccctccgatatctctcaaaaatctaatcttcacatacgatatatttattaatttttcttaaaattctaggtagatcaaatctaatagttaaaaggaggcttgaaaattatctagttcctacatttttgcttaggaaaatgaagtctaagcaagtaagtgagatgttcaaggtcagacagtgatttaaaggcacaaatggaaacaaaatctgactcctaggccaggatactttgctgtgactgtctttaaatgatctcacaatctggaaattgaaaccacacatatgaacacagcattctaatctacaggtacctagggaactactagtaatagcaacatagatatataagcaagatgatgtgttttgttttgtttttttgagacagagttttgctcttgtcgcctaggctggagtgcaacggtgtgatctcggcttaccgcaacctctgcctcctgggctcaagcgattctcctgcctcagccttctgagtagctgggattataggcacctgccaccatgccaggctaattttttttatttttatttttagtagagatagggttttgctatgttggccaggctggtctcaaactcctgacttcaggtgatccacccacctcgcctcccaaaatgctgggattacaagcttgagccaccgagcccggccagtgatttgttttattttggttcatctctcatgtgaaactttatatcagatttgaatatttttgaaaaatatttagtgcaagtgagagcaagagggtgccagtcagacttttgtcactgaaaggccttccatgtaatcttttaaatgctagctgagtctataataacttttagagtgccctatattggctgatttttcttacacatacaaacactgttgtccattgactaaattgcatatttactagaaaattatattttcaactaattttcattttagtactgaggtttttttggttttaaaatgaacagcataacaaagcttttatagactgcaatagtaaattatcaacatgcactgttaataatatccagcaacaagaaaaatgttaccttttgaattatctttataataagtagagctgtttctcagacaaagatttaagaagtctctctttcccttatcgaaaacatgatgttgatggatgccattttcatatggaaagctattcttctgacaatcatgaaaagcacaactttcacatgtaggaacaaacaaaataatagagttgaaaaaatgattttaaaaagaaaattttaaaagtcccaagtcattaaaacaaatatagtaaaactttaatagggttatttacattaatttaatatttattttaaccttatgtgaacacattctcaactataagtaactaataacactgtggatttaagatgaataggtaactggaccaaatctaatttaactgcaaaatttcagttgaaagtttgttttccaaaatatattgaaataagtttgatttcttacagtttcttctaaaaagggagtgttctctttcaagctcattaaaatctgatgaaatcaaggctttactactagataaacatattatttgttcatcaacaagatatgagtttaaaagcagtatgtgatatttaggtttcaaagtttaataatgattactatctatatgcatagttacaatttaaataacattctttatgaactgaataatatatttagtaatacctgatatttatataagctctacagaataccattataaaacttctggattatattcaaccgaaaaggccctcttgtgtcactcgtgatctccaggagagagagaaaattaatgtagttctatgggcacctccaaaccaaagctgtaaaactactgccaaatcatgatcagtaactttctctgccttctctaacaccttacataggagtcaaagcaaagacatgtgataagatatataaaagaatccgattagagaacagaaatgctattcatttccttagagatagagtggtgcatataaacctcttatctgctgaacagaaagttgtctcccgccaaaaccccacttccaaaagcacatttgctgctagagagctggttctgtgtgtctaaacatgggatttttctgttcaggggaatcactcaggcccatagctattgcaaaatgtggacgggggcctaaactgatctgaatcaagaattggtagaggggatacttgacaggaattccactccactgtttacaaatcctgaagtttcaacagcagaaagtaactgttttaacattactaacagatacagttagatattatttttcatttggaaatgagaaaattctacaacgcaattacaaagtgaaccattatacttcatttgtttactttattatacgttaaaatctacctaggaagtaatctatagtacaggagctcttttagtctctcagcctaatcatttataaaactttttatttagggttcatagaaaactgaacaaaatccagagtatctttagagagaagaagaaagctcatatgaaacatatcaaagttgatcaaccatttcagaggataacaacccctaagttcagaagaatgtattaaataatccaaatattaggtaagagtacaaacctatcactatagacagttttctaattgctgaatgttattaaatatcagcaatattgtatacatatttaagcatgggttaagtaaaatatactctgacattaatgtcacatgttttttcacaccacatatttcacatttaaaaagacagatgattttgtgtgtgtgtcaggagggggctcaatatgcacacaaagttaattagaaaggttttaccttcgttgactgtctgcatcagctaatttaactttgtaaggcacaatattttctgcttcttcaaattcctcttcataagtcttattaaattaatgttatataatattagtaagttcataaaaatttattacacattaaccaacttacttatgggtgatatttggagtacatttttcctacaaatgatgttatgagagctctaattatattttataacacataagttctaggagaactaaacaaattcaactgacattggttgatatgtcaattactttatcactattataataccccaatccaacaataataacttatatttaagtatgtagctactacctgccaagtagattagtgactaggaagttgtcagttctctgactggctcatcataaacttacgctgtgtatcaacaatgtaatgaatggcatgcccacatgtatgtagtgtgtgtgtttttgtccagtctctcaaatttatccagaggagaaataaaaatgttgttagccaaaaaacacaaataacaaaaatagcagaagctttcaacctaaagaagaaaggaagaaagcagtatttaaaagaggtaagttctccattctagtcattttcttaacaaccacagtaagagaaatatctaggacaagtggcacattcagctactatattactagaaagtcagaaatgcactgagtgtatcacaccctaaaccttcagtccagagctctagctctgacagggtctggctctagttgatgctattggtgtcttctacatatgttcaagttatgttcaagttatttgactgaacttcttaagtcttacacactatttctacatttaaacggaaaataatattaaatgacattcaagaaactaaatttacacttatattttaataggtaccatgtaacgagactgatatttgtttaaaaacttgataacatagagaactaaactaataaaatatcaaactacatatctataagttaaaatagtgaaatgtcttcttacctcccataatatattcatccaaaaaaattgacaataccagtttagctcacaaatttactgtttacattcagaataatattgttttattcttataagcatatttaaacccaaacacttgtaaatttcctattaaactatgttagttatttgagaaatcttattgaaaataatatgcagatgtaagtatacattatgaattccctgttaaaaatcatgaatggtcattatgcacttatgcacttacatcatccagttcgactatctttagagatggttcaggtctctctatgtttaatgtttctactggcaataaaagagctgtgtgttgtactttggtctcctcacctaggaaataagattcacaaataatatcatcaaagaatatatcttactttataatttcttcaaataagatagccaccaaaaaagaagagtgttctcatgtgtatctacacaaaaatacaaatactgtcaattttcccagttcaagtgaaatacacatttattagcattcaatttttaaatgaaactatctaaatcaaggcaaagtatatctagggaaagggaaagaagtgagtgtacatgattttcatctaaagagaaaagattacatggtacaactgagaataatatattaaagaaaaccaaaagcagattctgattaatgcttagtgtatataacttgagacaatacattttaaaaatatctaatcaagtatgaactaaccatcactatcttcatcgttttcattttgagaacactgtgcatcaccagtggtttcatgtggatgtgggaacgtatctggtagcattttaaaaagttgctcttgtggagttctacaaaataagaaagaagcaattaagagactgaaatatattacctgaaactttcccagacaagctcttgatttatttatcaaatgaatgagtatacaaaattaatgatgaaaccgtaactgtacctttaattcaaagataagtacaattgtataacagaatcttaatgtactaaaaaaaaactgtgtaaatcaacttgacatcacagaagatttttaaattgcatatcctactgagttttgtttaagctaaaaatcaaagttatgctacaagtcagtgttctctcaaaagccacatggagtccattaaaaacaccatgctacttaaaaagctaatttatgaatgtgagttttagttcacagtcttggcattgtgttgatgagttctacgggaacctgagggcatttgtctaaatttccatcctaccagcagggtggtaacataggctcctacaataaaaatgtaaggtgttcaggctgtggtatctattacttaattaacaatgaagactgctgcagcccatttcatatggaaggcagtgaagcccaggaattcacagaggtcaagagtgtatatttggtttcatagtatataaccaaattattggagagaagggtcactttttaaccaagaatatgagtagctgcacagcctttccataccatgcaagttcataaagtccccatgtaaaagccagagccttctcagtgatatttgtagttaatatggatacaaaatctaaaatataccaggctccattctaactaattttggtacattaaattttattagatattaaataggcactagtatgatcttaactttacagaggatgagactgagacacaaagtggtgtaccgacttgttgagtcattcaggtagtgaatgcagaagaggaatttgaactcaaggagtctgcctcccaaaaaccatgttcttaaccacgtacttcctttgtaatgcctcttctgcaactttcaaaggcattaaaattttgataaaattgacaagtgactttggaattacatttatatgccaattgttaattagaaaaaggcaattaacagatacacactactgttacacatatcctcattcacttttaaaatttgaataaatttgtggtgtacagttttgtgggtttttaccaatgcataaagtcatatggaccacagtaccccccaaaaaaaatagcctgaagagctattatgggcatcatactttaaaaaatatatacagcctggacattagttataaatgaattaccttaaacctctgccatataagctactacaatgagatacaactacacgccttattaaaatgtcaaacaaaagaaaaaaaaactgaataccaagtgttggcagggatttggagcaaccagaactctcgtaccttgctggagcaaatgcaaaatggtacagtcaatttagaaaagagtttggcagtttcttataaaaataaacatgcacttaccatatagcccacctatcacagtcccaggtatttacccagggaattaaaaacctatattcaagaaaaacctgttatgaaaatatttttaaaggacctagtgataattgccaaaaactggaaaccagccagaacaaatattgattcatacaagaacatggatgaatcttaaatgcattctgctaaatgaaggacatgaaaggacggatactgtatgatttcatttatatgacctccaaaaaaaggcacatttgtaagggtggacaacagatgaatagttgttacggactaagaaagggaagagaagaaagaggaagctcaagggaatgtggttgtaagactgttttttgtgggggcaggggtactgtggtagacacatgactttatgcattgctaaaaacccatagaactgtacaccacaagtttattcaaattttaaaaatcagtgaggatatgggctgaacccaatgaaagtcataccaaccttaaaggaggtaagaaataaatgagcactatggccaaagtaatgttggaaaacatggtttggcctagataccgtaggctacagataaaagcatgacacacaaagactgtactctaggtggaaaatttgtttctttcagtgatattattaacagtaattttgaaattaattgtcccttgtttctctcagtgatatttgtgattctgaaactactgtatgtatacatacatatatattttagggctaattaataaatatattatagataatgaaagccaagtttctcactgtaagtgaaagaaatttgtcaaataagcaaagggagaatggaaatgaatcatgtgatgctggtttggattcggaatgcctgggtgtgaatgcatgttactttaatagatatccagatggatagatacagaaaaaaatttatatgtgtgtatgtggatttgtgtgtgtgtgtgtgcacgcacgtgtgtgtgtgtgtacttcccagtttcttcctctgagaaggcctagaattgtggcaccagaatagtaatgatcacacctagagtccagatctttgtttctgagcaccattctccaataaagggaaccagtattttttagaaaaacaattccttggcttgggcagggaaaatgcatcttgagttccagaaaaaaaagagatgttcaaagcaaactaaccaaaaaaaaaaaaaaaaattgatgacaacaaatcaaaaggatggaagagtcaacccgacagagtccacaatggccaaggcagaaataatttgagttgcaaaataaataacaataatattagatatcaatccccaaaataaaataaatattcatgagttgacataaagaaaaaataataaaagtgggtgaaggaacacttcttttaagaggaattccaactaataaatttagaaggaacaaaggaaatagaatatctgcaatagagcaggagagtactaactgctgcaggcaaaattcactcacaaactctaaaattaggaggtgaaagtttaagggaaaacagagttgatgtatcatctcaatgtgtctcctctaaaatatttatcaattataaagggaaagtagtgattttacagtggagaaacttagcaccaccttaactatgtgatcaaggttaacatcatctgtaataagatatattgacatcacgatcccagaatgtcacgcactgagaaagacacatactctctgtggcatttttcctcacagtgtataacctcagtctaattatgaaaaaacatcagacaagcccaaattgagcacattctatgaaacacctggcaagtactcttcaaaagtgttaaggtcatgaaaggcagggaaagactgaagaactgtaatggataaggaaatatgacaaaaaatacaatgtgtaatcctggactggatcctggaatggggtaaggataatagtgaaaatgctgatgataaaattaaggtaaaatgtacagttctcaataatattgtccctatgtaagtttcctggttttgatatgcactatgtttatgtaagatgttaccattagagaaagctgagtgaatgttatttgggaattctttgtgctattttgaaacccatctgtatatcttcttttcaaaataatccaaaagaaaaaaaatctagcacattacaaacagttgaaggtgagtggtggtgcgggtattaacctatctagcagaggcttcacgggaaacatgagggctgatttcaaaaatctgaagagataccatggagaagaaaaattagattttatctgtatgggcttaataggtagaattagaaccaagtttagaaattagctggaaacagattacagttcaatgaatatctcttccacagatggaatgggccacctcgggagatggttttgcgtaactgaaggtgaagcaagggtgtgatgaccacttctcaggcaaattctagagagctcctccaacaacttgcacctcaaaaaaagaccagagaccagcctcatccaaccattatcacctgggagctattagaaattcagaaatacagaatctcaggcctcacttcagatctacgaaaaaataacccatattttgccacagtttctagctgattgtatctggtgatatctctttgaataaagtatatttaattactattaataaaattagaaaaatgtttaattaatttaaaactagattctgaaaattatagtctcaaatgttagtgctaatataaaaaactggtgtcttctcaaagtaatatttcatttatcacattatttttattattcttcttaaattcatttctgcatttgcgccttttccttatatacacatttccatttctcaaggaaaactgtaaattaatgatgcatcatatacataaatagaattaaaattcttattggaacagcaacttcacagggatttaatcttgctttaaaattatgtatgcaaatatgaaatatacatataaaattgctataggaaggcatgtcatacaagaaagaaacataaataactttcatatttcctaatagtattataatttcagaaaatacctcctgtgttttttaagccataatttttccatataggatagaatgtcttctttaagttcaatattaagtggttctctccaaattttcagattagtctgtacttcgcattcttccaatgagtctgtaaaaataaacacaatgtgcataattaaaataagcaagtttacaaattactatatcttctcttaagatgtagaactcatcatttttggggcatatatgctttaatatttacttatacaatcaataggttaaggtttaaataatgcaaaagtattaaatattggtaatttattaagggactggatagacagttttcttcaacaatctcttgaaatgaagggatcttatgattcagaaggtttgttaaagcaactcattcttttaaataaaaattataaatacaaacattcattgtacattgtataaacacatacataaaggtataatacacagatgtataaagtgttatagccactgacaataatatttacacattatgagaaacaggaaataaataattcataatgacatctggaggagacaattttcttcacaaatttatatctacatggtaatttacttccagatgtttaagatatttctgaagcactactaaattaaaatcactattcagagatatttaaaactgatgaagatatctaggaaagaaagcagtgtaaatccatgattactagtctctccaccctcccacgtatcgttcctgtctccaaactgaacatcacaggggaaaaaaaatgtaggagaatcaagggaaatagtaaagatgggaaaaacatttttttataaactaaggctagagggtgtcccagcctcatattgtagacttcaatgattaactgccagaaacagctacgggccagcaatggaaacaaattaaagtaaaaataaagtaaggaatcccacttctatttttcccaaagagtagagcagtgttgaagaaagcaattggaaaaagtttgggaaaacactgatcagaatcccttgaactgaaagagcagagttaaggacatgagcaagtcatgagagagaagaaatgcctccactatgagtcccccttttcattttgaaacaagatttcttgacaggagagctaaaagaggggggggggggaaagaactcttttgtttttgctgtctagatgttagagaagagccactgtgcttgagatataaactctaaacacagaagggtgatggaagaggaagaagataaagcagctggcccgtgattcacttttctcccttaccaatggcacattcccaagaaataaagatgggaggtgacctgggttaatttgtttgtgaatatgttgataactggacctacaggcaaatgaattaataatatttgctgggaggagactctttagctatatggtgtatttaaaatgctagctcttgtttagaattgcttgtcgtaaacaaacttacggatttatgaggcatggctccctgggaaatgccaaataaggtatgtaacttatgtttttatttgctcccttctttcatggttcactggctacattgtataagaatgtgcataagattctccatcctcaaattgatgggatcatgggtgttttccttaatagatagtgcaaaagtcctgatgggaaagtatgcctaaagtatgtgaagaacgggtagaagtcaagagtggctgaaacgaaaccagccatgcctgcaggagagtaacaggagatgagatgtctgagataatggacttcagatcacacataactttctaggccattgaaagtacctgcctttcacatagaaggaaatgagattttagaatactaaaacaaaaccaagttaaaaatcaataacagaaataactagaaaactagaaatttaaagcatactattaagctgaatggtcaagaaatatgtgaaaagatgtttcatgtcatttgtaataagagatacacaaaatcatctctattaagcaaaaatttttaaatctcacaatattaaatgttagtgataatggaaagcaaacaaaattcttttttttttctttgtgataggctctcacattgtcacccagggtggagtgcagtggcatgatcatagctcactgtaactttgaaattctgagctcaggtaattgttgaccctcagcctcccacgtagctaggactataggttcacattatcatgtatgacttttctttaaattttgtgtagagatgaggtctcactacattgcccaggttggtcttaacctcctggcctcctaaagtgctgaagttacagacataagccagcagacccagtctctttcttaattaagggattccagagctgtgacctggcttaggtctgaggacttcataaaaaactgaatccccaatatggtggctgaagccggctctctgcccattaaacagaaattttcttctactataggtaaaacagtaggctgcatgactttttcattcctaggcacaccaattatcgtcagaaatctctgtgaattgaaacactgatcactactcctccttgacccttacttcggtaactttttcaccataattttgaagattgtgtgccaacacctggcctctatcatttccattctttgaaatcaggatgcttggtcccattgaagcattcccctccagtcatcttcagcctatagaggaaggccacaacaaacctttttaagtattacggtgcttaatgccttggtaatgacagctaaataggttgcacattatcggttccaaaattcctatctcccaaagccttccaacttcttcttctacaaaatggcagggaaattacagcatctcaatctcataaactttcaaatcaagtccagttttcaattaaccaacccgcccaattgttactgccattcctgaagtgcttgagacaaaacactaagatccaaatcctgtgcgagtacatctacattgataaaaacaatctcatctaatctgatttgttttttatttcttaatctaacactgttaaatgtcttcttctacttgctttccaaactcgtgtgatacagttgaaaagaggcagtgcctgctattttcacttggcatattaatctgttctcacgctgctaatgaagacatacccgagactgggtcatttataaaggaaagaggtttaattgattcatagttccacatggctggggaggcctcataatcatgacagaagacaaaggaagagcaaagagacttcttacatggtggtgggcaagagagagcttgtgcagggaactcccatttataaaaccatcatatcttgtgagacgtattcactatcacgagaacagcacaggaaagacccactcccatgattcaattacctctcgccggggccctcccacaacacgtggaaattatgggagctacaattcaagatgagattttgatggggacacagccaaaccataacacctggtatggacgtgggcattgcacttcttcatccaaattatactaatcatttgatttttttgacctccacttaggctgtaagttccagacgaagttgctactgcttttgcacatcatttgaccccaccacatagcgtgtactcaatattcgctgatagaattattattgagagtaatgttgtatacctctaatatgtaaaacattacttgtgcccaaatattagcaaataataaaaataaaaggtaatgacaaaaatagccaatattgtctacttcacaaataacagtaaaaagccagttataatgataataatttattgtcaaccaaactggctaaagttaaagaaccagaaaatgcaggaaaatagtcatgtcacactctaccagtgagagtacaaccaacacagtaatctttttggaggccagtttgacaatattcattaaaattttataaaacaagtcaccactgaggcaacatttctatatttagaaatttattttaaggtaaatatgtaagtgcacaaatagctaagatgcccatcataatatcttttaaatactgggaattagaaataaaatatccatcgataaatgtctgattaaatcatgccatatagaatactctacaagagttacaaatgattgtgtgtatctctatttagatggccagttgcccattacagaatctcagtgaaaatgcaagttaactaatagtatttagtgttacctcatttttttgtgtgagtatgtgtgtgtacataactatggttattgaaaaacatgtaccaaaatgttaacatggattttctctatatgatgagactgaggtattttcattttcttcttggtaactttttgttataaccaagtctttcaaaataagcattcattattttatcatacagttatttccattatgaagaacaaattttaaaagagttatacttctgatctggtgacttttcaacttggtacagtattattttaaatactatggcttccaaagcagacaaagaagaatttctatagaataattagtacttttcagagttgacaagtcaaaaaaaaaattgcatgaagtagcaagcataaagcacataaaataacacagccaatgagaaatgaggtgtatactgagatataaactactaagaagacagcatccaaataatgtcttgaaaatgtcaatgaaattgatgtgtgataaagaaatgtagaaaaatacttgaagaaaatttatttaaaagtttaattataattagaagacattgttgatactttgagattagaaattacactgtgtaataaaagtgtaatagtcagaagagtttctccaatggaaaaaaaatgaaataaaaatagtaaaattggcaagtaagatacatgattgaaatttattatctaacattttatattaaatgaaaagcaattggaagacactacaagattctgagtaataaaattaataaattgaatacttttaaaacttatggttttcctcaagacatactgggaaacttcaacatactgttcagtcatctggatcatcaatgtctagaatgtaggagcgaaattataaaaaaaaaaaaaagaacgaaaagtagttcaaaaagaaacaaaaacaatgagaacgcaaatcaattctcctcctgaagttcatagtggtccttaaaattgtatttttaagtcaaatattctaaaaaaaaaaaattcctctttatctcacagactctcccattttatgtgttacaattactgctcaaaaaagcaatagttgtcctggcaaaaatttctactagaagaagaactgaaagaatccaattatccattcatttgacagtctgaatttacacagaaaacaaatgcaaatccccctagtgcccaattcagggcctataaatattaaaccactcaccaatgatcacacagtgcatactcctttgaggagttatagcaaactgctgtcccagtgtttatagattttgaatatcacatttatattcacagagaatggaggtaaataaactaaagtcagcttcattttaaaacattcatggtataaaaaaccatacgggctgggcacagtggctcatgtctgtaatcccagcactttaggaggggaggcaggcaggtcaggaggccaggagtttgagaccagcctgcccaacatggcaaaaccccgtctctactaaaaatacaaaaattagccaggcatggtggcacgcacttgtaatcccagctactcagaaggctgaggcaggagaattacttgaacccggaaggtggaggttgcagtaagccaagatcacgccgctgcactccagcctgggcaacaaagtgagactctgtctcaaaaaaaaaaaaaaaaaaaaagccataccttttactgctgcatgtaaattctgtttcttgttgtcatcatgatttccggttctccattgacttaacacttcctgaaaggactgtgcagaagcttcttcatcgaatgacccttcacacaacagactctttcttggttttgtacgttgtgctcttttcatcgttgtaatttctacctaattaaaaggatacataggcatgctttattaaattttctgtatttacccacaaaaattgttttaataaaaaaattctgtgttttaaaatacaggtagaactaattattagtcatcacaaatcagactttttaaacttagaatatttttaagttgtgcttatttatatgctttactctgttatttaaaactctattggcaattataaatggtctcttcagaaatcatgaagatgacagcctacagaactaatgacttatcattatgctgttcaccagtgttctctctgtaaaggtgcaattgccttgtatccattctccctacgcctccaatctcctactccccgcaaccttctcatatcaaaaaaacagggtttttttttaatgtaaatctgatcagacattcccctgctcaaaactctctgttgactgtctatgaaaccccaagttcctaccaggacctacaccgccctacacaaccttgtatttccttgccttttactttacctccttccattctcctttcattcaccctgtaccagctagtctcacattcttgcagttctgagaacccatcaagcacattgcctcttcagggccttgtattagctatacccaatgcctggaatgagccttctccatatctttacatagccattccctcattttgttgactcaatgaaatgctcaaatatcacctactcagagagttcctcactaccaattctaaaactaataggccccctttcccccatttaataattccttaactgttttattcttcctcccattacttactcccatgtgactttattctatatgtttatttattgcctgtccttccccattagtatataatgaagttgtggattttgtcttttttcttagtgccaagacctgtgcctggcacaaagtaggtgttcattaaaagtcagtggaatgaatgaagaagttcatcgatgcatgtaatacaatgcatgctcctcagattaatgatggttgtggagagatgaattcagtacaaaatataaatccagtccaagcacacaagaaaatgaaggaagtatttggaagctatgcagtgaatcagagagaacagccacattaggaaacccaagcaaagtaaaacccacaccaatggctgaattatcaaatgtggattacctacactggtcaaattgctaaatatccatgtgtatcttttaagacatgagagtataaatctctatgttcagcccgcaattgaaaaataaacaggcagcttgttagagtacaattcagggtatattgttaaagacgtatataagaaattttaaatacgagcaaaaagtatctgaggacctgtcagacactagacaccatgctaaccgttggccacagaaacacaggttaataagtccacaacagaaaaaggtgcaagaagcaggtaaaactcaggggaaatgatgtctgaattggattttgaaagataaaacaagaattccataagcaaaaagtgccaaaggcagcattccagagaaaggaaatgatacgtatgctaggacatgggagtcaaacagcattggtggcatggaactataagcagtttgcattgatgtagcaaaaagtaaagaatgagaaaatataaagggtagaaaggaagcaggggaagaatatcaagggctctgcctgctgcacagaggagcttaaacccattggacatgtaaaaccattgtaaagtcccatataccagtgtggcaaagagagggaaattataaaatagtgtgtttggctgcaaggaaaccaattaaaatgttacagacatttgcccacattgatcaacattacaaatgcataattttttatctaggagtttcaggattttatcatactgatatacttacatttgtgcaaaaccacattattcaaaattatactttatattttagcatatactggcaaaagactgaaatagcataaatgctgatcagtggaagatagatttttaaaagtcttttcacatccaataaatggagtattttacagccactacatagaatgagaaggttgtaggatgtacttatgtgaatataaaaactacaaagttaagtgaaaaaaaatgcagagcaaacatgtttgtagagaaaacatattaacgtttgtgtaaaaaatacatacaaaaccagaagggttgcctgactcctagaagagaatgaaatgcactttccatttataaacctttttttaaagaagaaatttcagtatctaaaagagcaataaggatagaataaatgaccaaacattcaagagtttttagctgggagcctatatgggacatgataactattgtggactgaattgcatcaccgtgcacaaattcatatgttgaagccctaacccccaatgtgactacattttgagatagggcctataaggaggtaattgaggttaaatgagattatgaagttgaggccttaatctaataggattggtatcctgttaagaagagggagatagttggacgtggtggtatgcacttgtggtcccagttacacaggaggctgtggtggaaggaatgtttgagcatgggaggaggttgcagtgagctgagttcacaccactgcattctagtctgtgcaacagagcaagactctgtctcacatgaagaagaagaaaagaagaaaaggagaagaagaaagaagaagaagaagaaggaggaggagaagcagaagcagaagtagaagaggaagaggaggaggaggaggaggaggaggaggagaagaagaagaagaagaagaagaagaagaagaagaagaggcatcatatatctcttctctctcctctctttctttctctctctctctctctctcccccactccccttctgtatgcatgtgcatacagaagaaaggccacataagaacacagcaagaaggcagccatctaaaagccaggaagtaaagcctcaccaggaaccaatactgccagcacctttatctgggacttctagactacagaacagtagaaaataaatttctcttgtttaaaccgctcagttggaggtattttgttatggcagcctgagaaggctaataaaggtaaccaactgaatgtgcagaggaggaagtgaaaatactacagaaaataactgcctttgttggcttggaaagctaggtagggcgcctccaacaataacatttataggttttggaaaagacaggataaatttagtttaaagatagagtcttaggagtatttgtgagaaggtacttattggtatccagtaagcaatatgtcagtgtatgtatgtatacatgctacactaatgaacaagcattgaaaactcagtggcttaatacaaaatgatttcaacatgcagcaatttcagcagccctccagggaagcttccttccaagcaatgaatcagagatgtcagacattttcatattggagttatgccattggaatacctggcttccacatagctgtggcagggtagaaaaagctggagggttgtacattagctcttaaacgtttcagctcaaaactgtcatatatcacgtccactcagagtccaatatgaccttgcccaatgctaaaagaaatttgaagacgcacatagaaattcaatgctgtacattcattaccctgtaagcacatgatatccctgtaagatgatgtgttttaatatccccactttccaaaggagaaaacagaagagcaaaaaagctaagtaacttgcccaatattacaatgctataagaaaaacagcatcactatttcaaacccaggtttcggcttataagatgtaagctctttcgtgaactgtacctctttccaaggatgtgccattggctttgatccattaaaaaggccataagagaagcatcaggcattggtaccatttggctcttctagccattaaattaaaaataagactcttgagccctaacccagatgtaaatatttttaaaaatccaaatttggtggcagacccaggaatgcaagtttttaacaatctccaattcttatgatgcttattacagttggaggagcactgctctttggcacagaggaacactaagcctatgaagcggttatctcttcattgtgtactctgtcgtatatagcagtgactcccaacaagaacactcaccagaatcactgaggagttaaacacacacacacacacacaaacacacacacacacacgtctgaaccccacccacggagatgctgaactcaatcatatgtatttctttaatgtttctctagttgattttaatatacactcctggatgaaatcattgaattaatggtttttaagttaagacaatgaggcagacaatgtatacagcatgcatagttacctatgaagaccagaagaaacatctagtgtaaagattaataaataacacagaggagcctactctatcactttctagtaaggctagttactgaatctctcatctttctcatctgttaaattggggtaataaaagcacaaaccttacatggttattgagattattggataaggcaagtaaagcattaagcacaatgcctagcataaggtgttcaataaaagttagttgctgatttatttttgataggattaattagatgaaaagggaggcacgaagaagaaacttttaaaaccacagtctctgcaaaatagttaaatgcaggaaatttggagtcagaaggtctgagctgaaatctaagttccattatcaattctacctttggcaatttataaaaactattccctgccactattctctcatttgaaaaagaggaataattaagaaaagacaaaaggagataatgtgtaaaatatttagggcagtgtctggtcttcaatacattattattataattaggaggcagtgattcttcacaaaacatccttgacaggtctattagaaagcgaaatccacacaaatatgctgacactcctgaaaaattcaagcacactccctctgctgaaaataggtcctactagcatagaacacattttcttttatgtctatgagcatgggtttggaacgcaacagatttaacttcaacccagacttggtcaaaatataacaagcagaatgacttcagctaagttacagtttttgaactgcagggaaaaggtgactggcatctaaaagaatgaggattataacatagatcaaaatttgaagttcatttcttgctaaagaatcaatatgtctattataaatatatagacatgagttgataaaagcttatctagcatgttgtcagatcagcagtcaatctaaataactgccagaatttggtataaatctggttttatataactgtgcaattgcctgtcacttaaaactctgggcaaggttttgtatttttagcttctctgaatgaagtcctgactaatataaaattgttatattgcattgtggtttttaaaaaaatgttttccccaaatactcatccaattcctgacatggatgaaaatgtccagaaagacatatggtcaaaagatcattcaccaaaaagagtagtgttcagtggaatcaaagcaggcttcttgaaaatatttttatagtcaagatgtatttggttaatgaagaacaaatccatatgaaataaaaatgtgatgaaattattggtgaaattctatagctcaagttaagtacatgaatggcacctgccatagttacatatgtcagaaaatgtctactatattttcctcagtttacctcagagctgctcctctggagaagtacagatttgggtttatgttgaattttactggtttcctttgtagaattattctcctctttgggttcatctggattaacatcctttataaactgatgggcaacatccaatacattgaataatatttgagattttgcctattaaaaaagtaacaatataattaaagcgcctcatatgttaacctaaataatttatatacattaactcatatttgtgttattctatgactcccagaattaaataaattcaatttaatatttaaaaagacaaattggcatttgtatcaacaagtataatagtgacagctgccatctactgagggaactagtttggcctcatacaattcaaaccatcttaaaaacaatatatcacttaatcatcaaggcaattctaaaacataaatatttttatctgttttaggaattaagaaaactaaagcttaggccgggcgtggtggctcgctcctgtaatctcagcaccttgggaggctgaggctggcagatcatttggaggtcaggagttccaggacagcctggccaacatggtgaaaccacatctctactaaaaacacagtaattagccaggcatggtggtgtgtgcctgtagtctccgctactcgggaggctgagacaggaggattgcttgaacccaggaggcggaggttgcagcaagctgagatcaagccactgcactccagccttggcgacagagcaacactccatctcgaaaaaagaaaaaagaaagaaaagaaactaaagctcggagagtttaaacaacttgcccttggtcacagtgctgagtgggtgccagagttaggaagtgacctcaggtgtgtataagtctaatgactcataaactttccactatgcacacccccaaatagatagatgcgatattttgtgcacatcataaataaagaactaaatatagctaatctagtaggagactgaataagcagtaatgactactccatggtgataaaacgtctttagaaagccttcactatccaaaggggtacatcaggaagcacttctctctgtagttccttaataaactccaagtcatttctcattttgttccttgctcatgaggctcacttactagggaggctttctctcctctaccatcatctttacctggcaggcttttgcttctcctctgcattcacgccattactccaacaagtctaggaacccttccttgcacactgcactaccccaactgtacacggtatttaccctctttaccctcttaatatcctgcgtagatctctaccagccctaactatattgatttcacatttcctcatatcacataagctcacaaaaggaaaaaacatatatattttaatgattttatggctactacagtttctggaaaaatagcatacggtaaaaataaggtgtcagggaaggaaaagagctacagaattaaaataagtaatttagaaaagggatttaaagaaaaacttttcacatgctgtcagagtgactgacaaagaactggcaaatttggggaaggccccattctctgaagggttttctatcagaaactaccagagtctgcctagggactgcaggatttaggatcctatctgagtttgaattaaactccaggggtaagattcagaatcgtcagatgctctgtgagaacttggcatgaggaagacaggaagtagctcttatttcttagcaaatatcctccaaacaagaaaaatttagcagggatcagataaaattattttgtactctgccatgaaaatgctcctatttttaaattttcatctagttgccaatttagatagctaacattacattgaaactttttcagttatgacatttgtaaatctattaagattcattgcagtctgattctggaatatatcagtgaacatcaaattaactagtgttatttcatactgaattaataaaatacctatgaaaaatgatgaacgtgacctatgcatatatattgctgtctgtatgcaaatctgtggaatctgctccaaattttcccaatgattctcagaaaacctatataggcctatatagtccttttatttttaaaagaaattcaagtcaatggtaatgcttcactctttcagaaacatctgtagttttaccaacatttttaaaacagaataatccaaactaagcctcatttaaaatgtcctagaataaaggtctgtagatttcagaggcagttagttccatgtttggttttcattttattttttttaaaatatcaaaagctataggattaattttatataaaattatcattcaaatatatgtttatttaagtaacacaaaacaaagattatttctgtcctaaaatgaatcctgctatcaatgttataataattgttataacatttttaggtagcatattaagagaatcagaaatagtgaaaaacccacattttttatgctaaaaaataagataaacatcataggtaactgataaaatagaattccatatttgactatcttaaagttctgctactttagtacataaatgaaatcaatacaatgcaaataaatggaaatgttcttttctagaacatcatactcttaaacattacttttctccattgtaaggctgtgtatgtataccttacttttcttaatcttagaacaatcatacaaagaaagagagcagatattatgattcccattacatagacaaggaatttcaagttcagaaagcttaggccaaagtcaaatggctacaaaatgtcgtgacttgaaatagagtcaaattatctattctagcttaattaacctttttccctactagatttatgttagtctttgtgatacagaaaatgtgttttacctttgatttcccgaaactgaaaatattaaattttgtctctaacagatttgaacattgttctttgctttaaaaactcacaaaactttaattctgtattcaattgcatatgcaaggattaaggggtttagttttgtttgtttctttgcttttaacttatttttgcctgtttatttttatatttgaccaagtatatagaaataaatcatagtcataccatataaaaaatttaaggaatggaggttcctcctattttcaagcatactttctctgctgaaaataggtcctactagcacagagtacgttttattctatatctatgagtatgggtttggaactcaacagacttaatttcaacccagacttggtcaccacataacaagctgtgtgacttcggctaacttacagtttttgaactgcagggaaaaggtgagtggtatctaaaagaatgaggattataacatagattaaaattcgaagttcatttattgccaaagaatcaatataactatagtttaattatattaacatgagctgataaaagcttatttaggctgggcagggtggctcatgcctgtaattcgaacactttgtgaggccgaggtgggaggatcacttgaggttaggagttcaagaccaacctggctaaaattgtgaacccctatccctactaaaaatacaaaaaattagctgaacctggtgttgcatgcctgtagtctcagctattcgggaggatgaggcaggagagtcgcttgaactggggtggcagaggttgcagtgagccgagattgtgccactgcactccatcctgggtgacagagtgagactccatctcagaaaaaaaaagtttatctaggacattgtcacactcagatcagtagtcaatctaaataactgcccgtatttggtacaaatctggtttatagcaaaatagtactccccagagtaactactgttaacagtttttatcctataacctttgtcttttcttaaatgggcatatcgtataatctttgtcttttcttaaaagagcatatctagatttacaaaagaaaacacactgcctttcacttaataatataacaataatcattttgagtaacaacaatgaataagaatatgaaggttatttttagaaaatatttaaaatagataactatacatattaagtatcataacactgtaccatatattaataaaatattttcaaatgttaaaactcaacctaaagatagttttatttccattttctaagtataaaaatttaaatgtgaagtattaataggtaacaataggagcaggaggagactgaaaatgtataaaattacctgtgcaactgctctacatgctaaaaatgttttaaaatcaaaccaaaacagccttcaaggcacatagtaaatcatatatctcactctaggatagaaactaaactagagccaaaagatgtgatttactgccagcatttccagattcccccacatccttcactacactgtataatggtaggatttcatctggtaactgttctaaattctcacctaaactttttttctgcctagaatgatattatctttcaaattacactctagaagaattcatcactctgacaatgtatcattaatcaaagtaaagagggttgatattttatagcattttggaatggatggcaccttgtagaagttaaagcccaagaataaaagttttagtttagttagaaaaatgatatactttatggtatagtcagtgcttcaaaattctaactaccatcatcatccaaaactctggctatccagcaataaatattaataatcatgttgacatagccatatctccttaagtgatccagaagttccagatcaaaaaaaaaaaagttcacacatagtttagacctgtattactttgcaagtttgagggggaaaggaatgagaatgtctcctttcctagtgttaacttgcattgatttttcagtcacaaaattttagaagagatttattgtaaccacagccttgaattaaaaactgaaaactctaaactctgcagaagagttctgttattttatttgagtttgttagacaaagtgatatagaggtagagagagagatacacacatatacacacagagagaaaaaattgtgttatagcagaactcaagtaacataaacttattggttgcagtgattgttcgatatgattggaacttggaaggctttatttacaaaatcatttcaggatgatcaagttatggactaatgggaattttaaaattgttatatatattctataaatctttttttggcctggcttttgagaaaacacttccttctcatatcaagaatatttcaaagtacaatctgttctgatttctttgatgtgaattacctcatatgcagtcggtaaatagggcaatgatgtctgtattaactccagagtgttattgattcttaaggtttttttcccaacgtgttattgttttgaagcaatcaggggcaagctttcttacaactaaagccaaaatcttaacaacatatgaaaaccataagaaaaaaacctgaaaaatatataaaaatgcctccccttagcttaagttctgactgttttagggacttcaacaaccctgcatttcactaagttaagccatctagaaaaactatgagcacaaagaagctgtaaagacacctcctctgactttaaagcaacagataaataaaggaggctatatcttgatttagatttttcattttggtaaaaataatctctcttagaagtgaattactactgggaactacatcaccaagaagtaagaacaagtcctcaagaagtatgcattagtgttttaactaggatttgttaactgtttttgtttgggttttggttacaaagcaccataggatttgagtggccttctcctagccctaatcttccctcaagccctgttaattaggtgggcaattttccaaatgagaaatggtttgtttgttttgtttttattttaagttccaggatacatgtgcagaatgtacaggtttgttacataggtgtacgtgtgccatggtggtttgctgcacctctcaacccatcatctaggttttaagccctgcatgcattaggtatttgtcctaatgttctccctctccttgcctctcacgcgtcgaaaggctccggtgtgtgttgtttcattccctgtgtccatgtgttctcattgttcaactcccacttatgagtgagagttgattggttttctgttcctgtgttagtttgctgagaatgatggtttccggcttcttccatcaagaatcatataccgtgttgtggcagcaacacatgtatactgaagaattatgctttaatttatggtaaaacaaactcttttattagaagtcatcaaaacatttgctaaagtttatttatccaaagaaacctgtacagattattttgccaggatatttctatttacacattacatggaatacattgcactatgagtatgaggatcctattatctaaaattgataataacaaattagactaaatctctctaagtttggagctataaggaaattactacaccaagtagataaattattcatattatcatagacctaactacatcaagcaggtactagttacaccaagcaaataaattcctcaaagtatcatagacctatggcaggatgcaataaacccatcaaatttccacttagtaaaaatatctttgcaaaataaaagtaattttcatataaaaaatacataattttgaacatcttaatccattaaacaagaatgaaaaaggtgagcattatctctcaatttttttacattattaaaatatgttttatattcttaaagcaaactattattttacctttcttatgggtccttctttatagatagtcttagaccaaatttattccctgaaaataggctttatcatagtcaagtctgaattctcgctgaaaattaaaggaagctatccataaatgattggatcaaagttttcatctactgttagaatcaaaagaaagggttggggggtgcaggggagtaaactttgggccaactggaaaaggtagagaagcaaagggaagaaatttgtatatagaagacaactggaaaagaaaaaaaaatttgaggaaaagcccccatctaaatacatagagaaacaggaggaaaataaatatttattagatgaaataaaattgcaatggaagaactaacagcagaatcatgttcttaaatcctgttctgctcatcatatttctaaaaacagatatggtatttgcaagagtagtggtacagaaatatcaagggtataaaaaactacttattgcaagctagatagaaatcaaatcctgcaaatgtgaaattcatgtggctgaaatttattgcttattccaacatcatgtaagtattactttaagtagttcttaaaagactgttagattaacctttcctctaaaggtctgatttctatctggttttattaattaaagatttatgtattattattcctccttgacccatagagtggcaaaaaaagcaaagacctggacacatgctcctgcttatgaatgcaccttattatttaatagatagattaaataaaactggactcaatatatagtactttataaaataacatgaaatctggactcagtttggactcaatatttagtactttataaaataacacgaaaataatgaaataaaacacatcaaatccagttaaaatattttaaaataagacaacatataaatggaatagctgaaaaagtaacatattgtcaaaaaagtttaaagcacctggtctcaggaaacataacaacattggattttggttaaataactgtgcctttcaattttcattacactacaaaattctacttagaaagcaatctcaaaagtgagacagaatagcaaaaacaaaataacataagaaactcacacctgtaattttgctttctatttgcagttttgatgccatataattatgcactatattaattatcttagcaagtacttgcaatttttttcaactaatattacaagtatgttgcatccagatgagttaactgctttcagcaattgttcatatttgagctacacaaggaagaaattgtatatgcaatgaaatggataacatttttaggcataacagaataaacttactaacaaatagcaacaaaatttgtcatatttggtttttaaatatagtattgctgttacatcacaattagataattcgtatcccataaagaccaatgaacataacgtatattacagcaagcaaaactactgtaaaatttgtcagattccatgaaaaaaatcatgagctcatttgagctacataaggaagaaatttcatatgaaatgaaatgaataacatctttaggtatagaagaataaacttactaacaagtagcaatcaataatttgttacatttggtttttaaatatagtattgctgttatatgacaattagataattggtatcccataaagaccaatgaacataacatatagcaaacaaactactgtaaaaatttgtcaggttccatgaaagaaatcatgagataacataggtagcacctgcaaattacaaaagtccctcaaatattctgcatcaacatgattgactaaaggttcagacagtgggttagactaatgatctttatggtcccctccaaaattgagattctattatcctctatgtgtgaataaattggaagactgtatttttatatatactctgataaattgagctctaaaacttttactgtatgggtttttaaaatacaaaaccattccaaaatatgtgtaaccataatgcttttaaaaaaacacccctacatgcatccatctgtattattaaccgtaggtaccatgttgtacaacaggtacccagaactcatttatattgctaactttaactttctacccattgaacaatatctattttccctatccactaactaccactattctaatttctgcttctataaatttgactgtttaaaatatctcatataagcagagttatgtagtatttgtccttctgtaacttacttatttcaattatcataatatctttctggtccatggtaagtgttattaccacaaaaaaaaaaaaacaacaagggacacaggaaacttttggaggtgatggatggatgtattaccattattctggtgatgatataatgggtatatgtacatgtccaaatccatcaaattgtgtacattaaagatgtgcagtttttatctaccaattatacctcaatagagctgtaataaaaaagaaaacagccctcaacacaaaattaatctttttgttaatcctttggactcatcattaatattacattgttttctgggctttaaatgtagataatataggaatgggattgaatttctactaatactgtatcctgactgataaaacctaatggatggagcaccttctatgagcagaatatttttataattgttggcatttaatgtgattttcacaatagccctgcaagcttctgagcttgcatatataaatatgatctttcaaaatttcctcagcataaacatcacagaaatactcacctctccctttaaggttgattcatgccatctctgggttaagcccctgtactgccactaccctctctactgtgtcagttgctctgtcatttgctgctgtaatatactcactaagccacttacattctcccaactcttcattaactctaatttccattctccctacccctttcaattgtctttatttccccttccctagcttttcttagaactggcatctaaaagtaattagcacagatataacttcactaaagtgcaggctactgaactgtcccacatccaggtcttcgaaaaattcttgtcaaaatttatcccaggaagatatacaaatggccaccaagcacatgaaaagatgtttgacatcattagtcatcaaaatgcaaaccaaaccacgatgtgctactgcttcatattactaggatgttagaccaaaaagtcagataataacaagtggtggctaggaggtagagaaatcagaactcttgtacatggctgattggaatgcaatatactgcagccactttgaaaaacagtcttgcagttcctcaaacaattaaaaatggagttaccatatgacccagcaattccaccagtaggtatctagccaagataactaaaaacatatggccacaaaaaacttgtacacaaatgttcatggcagcattacttataatagccaaaaggtggaaacaacccgaatatccatcaaatgatgaatgaataaacaaaatatgctatatcaaacaatgaaatgttattcaaccttaaaaataaatgaaatgctgatagatggcacaacatggatgaacattgaaaacgttatgcaagtaaaagaagccactcataaaaggccacatatgacatgattctatttatatgaaatgtccagaataggctaatctagagagagagaaaggagtattggtcccgagaatatagggagataggaggaggatggagcaaaagggtatggggtttctttttgaggtgacaaaaatgttctaaagtcaattatgctaatagtttcacttagcagtaaccatactaaaattcattgaattgtgcacttcaaatgaatgaattgtgtggtatatgaattatatcgcaataatgctgttcttaaaaactttttgtcaatgattcctggacaagtgtttttcatttgtcttttggctatcccaacattctatgtttcaaattctgactcatcaaggacttaaatgccatgctcaccagagtctgcctgtgttaactaaacctttaaaatctcaagactgctatcaaatcctcttggcatcagtctattcagaaggatgaggacaggaataacagtttgccagcaggacagcatcagctgttcctttttggtggtattcttgcaggagttcaagcagaagtacagttcaggtagataaggaatacacctgatttagaaaccttactttccaccagagccaatccccacctcatagctccagagctagttccatagtggaatgtttcagttacaaagcccactgcactcagggagctatatcttccttcaagtatgtatagttctccttgtttagatgtaatttgccaagtagaggttacacttaccataagtatgttgcctaggaatgtagttgacatgactacctttatctgtttcccagggaaagggcgagaaagttaattaaaggtcaaatgctcacatttaggaggaaaagcttttgttaacccttcactgatataacaacttaacataccataaatccttttaattatccaatccttggttaaaaattcccttgctttcaaaattcagagaaaaataaattttgccctaaaatacagttttacgctatttcaggagcttaatcaaaccactaaggactcattcacatttctatttgttaaaaaattgatttatacagcacaggtacaatgttaagcactgaggatacagtgatgaacaagacaaaaaagagtccttctcacaaggtcctaaaatttatcagaagatatgatagtcgatagcaacatggtttttaaaatcttttgatagaagaaatgccaggtgataacaatcattgaagggaatgaacatgcacttgtagtataaggaatatgcattattcatatttaagaaataagttaaaaatatgacaatactcaattgttcacatacatttaaaatattttatttttcttaagtataacattaatacttacaaatagaaaattcatacattttttcaaaatatttacatacctggactctaaaatcatgtgactttatgataattccttttttgggagaacatttacttgtcatccacatatttcaatcttattggtaactctgagagaaggaactgcgtttctcaactctgccccttctgtggtctcccatcaagctaccattattgactttcttcacataactagaaaaaactactttaaatttcatatggaaccaagaaagagcccatataaccaagacaatcctaagcaaaaagaacaaagctggaggcatcacgctacctgacttcaagctacactacaaggctacagtaaccaaaactgcatggaaattctacctcaattatcttttctttcattaataccacccaccttcccaaggtttctccttttcagttaagaaaatttccattccaattaagaaaatgtatttaccataatctattaataatttacttaaactaaccccccttgtgcatgtcatacttcacaaatagaatgctttttgtttgttttccctcatcttctattctctctaattaacattgtctcttctgtctgatcttacgttgctaaaaggaaataggaatgcctgatatattaagacctcatttctcatctgaaaataacttttgtttcaacccttagtgttgacaatctttctacatgtagaagtaaaattttaatccttaataattgcctctcatgcatttatgcctcatttttcagttaattaaatatttaacagaggttggaaaaggcaaagaaacttgaagtgttttgaatcactgccaagtacaaatcaatcataaatcaaaggaaaggccctttgaaattacaacactagtcaacatgtaaatatttgccttcaatttttcagagatcgtaagtaaaacaaggtatgctgatacaaaatgatccatactgactaaactcacaggacctactgggctgttggataaaggctgaaacagtttacaactatcaaatttggctacactttatattaaccacaaatgacagcacaggttaaagaatataaagtgtaatcaccgtcagcctagaatacttgctttttatatagcaatgcttaatattcatctgtcggatgtcttccctaacttctcaaattaggaatggattcagcagtcaacaaagccttatgactttaatggttaacaataaaaaacaaaaaccactacaagattggttagtgagagctaagaaaaagagatatctgaccaaatggccatcaaagccaaagcacaacaacaacaacaaaaactttatgcataggaaaatgataaaaacaataagacaaaaaagcatgttgactgaaaaaagaagtgaaaggttaaacagagactagagatagaaagaaaatggcagagagctacaagacaattgattaaaatcaagaaatgatgacagagaatgggcaagaccagaataaaggagaaaaattaagtactaatcagaatagtgaatttctgagggggaatatatcatcataaacactatatcagctatttgaggcctctttcttattctatttcttataataaaggtggttattataacaggcatgagtcactcacacatagtgaaactgttcactgtgctctatttacaggagggagtacgtagtacaatttgaaatagtttctttcaaaaaacatctatctaatttatttattattgtatatatttaaagtatacaaacatgtacatgatgttttggtatgcatgtacatgcacatgacatacatatacatgtaaaatgataactaccattgagcatattaacatatccatcacctcacacagttgcttctttttagtactaaaagcacctatgtataaaaaatggaatattattcagcctttaaaaagaagatatgtttaactatgacagcatagataaacctggaggacattacagtaaatgaaataagccagacacagaaagaaaaatactacatgaaaccacatacatgcagaatccaaattttttttaaaaacttttcatttaaaatttttgttttatgaataaagggacaaattcgctttaagaattagctgaacaaaaaagctgtctccttcaaagtactttattccttagtaattccgttaggtgaaataatgttataaaaaagagaataacatcattataggtttagctcccagcacaggaagtctgtgtatgctctttgctaagtgccaacctcacaattccacttccctagtagacaatacacttcctaggactctccccaacagcagcaccaagtagcaactttggtctccacagatggtgtggaaacataaaggagtaacatgaacaaggaagagacatagttctttattgtatttaactttaaatttatatacataaaagaatcccaatatttgaagaaacctttaaaagaatcatagttccttgccaagctctttgatttgtgtacatattatgtaatccatgtatgctaacttttagagataaatgtatattctacaatgagatttattaggaacttaaataccattttactatttgtggcttaccaaccttccctcctctgcaatcaaaaccaaagaatgtgatgctggcagtatcttaagtgttcttaccatgaaagaaggaaagagagaaagagagaaaaagaaggaaagatgaaagaaggaaggaaggaaggaagcaagggagggaggagggaaggaagggagggagggagggtggaagggaaggaaggaaggaaggaaggaaggaaggaaagaagaaagagagaaagaaagagaaagaaagaaagaaagaaagaaagaaagaaagaaagaaagaaagaaagaaagaaaaaaaagaaaagaaaagaagaaggagggagggagaggagagagagaaagagaagagggagagagaaagagagagaaggagagaaagaggaaagaaagaaagagagagaaggaaagaaagagaggaaattgtgatgtaatgtgaagtgatagaaacattcattatgttgaatttggagactatttcaaaatgtgtatctatatatatgtcaaaacatcaaattatgcaccttaattgtacacattttttatttgtcaattatggctcaataaagatagaaagggagtagagagagtctgtagattgccatacatgttctgtgcaaaagaactatgtaacccgaaggaagttatacaaaagaaacagtaaacatactatatatatatgaagtgtatattcggtagatattttctcactaatttaatccaatctacatttggaattttacaaatttccaacctacaatgatcactttcttctgttaagatacaggatacatacactttaataatattaacaaaacaaaataatgctcaacgtttagaaagcatactgtatgccatgttgctttcagtaattatttgactggtgtcgtatctgcatctggatcacaataagccatatcacagcaaagtctatcttttgaaattatgtgggagggagaggagaagacagggagggagagagagcaagaagaagaaaatcaaatttggataaatcttgaagctcagatactgaagaaatggagccatgtctcattgttctttgtatctcctacaacagctagcacagggcttaacgtcactgagtgataactcagaaaatgtgctcaataaatcattgaatgaaaaattcctaatatgaactcatctgtgataattttgttacagtatttatctacaaagtagaatgccttttgttaaattctatattattcatatattaacaattagactcacttctgtatcaattaattttcatttcttatgactatctgattgtaataccatgagagagagaagtagcaggttggtttttgtttttttctccctgcatcctttctgcccagaagcgctaaacattgagtggtcactcaaaagtcactgactttggtgaatattagttaggtatattttacattttgtggttatcattatttgggtcatcagcacccttgatggctactgatatttattagcatgttcaggtaaacgcaaagattgaaatctaccagtaatctttctaaacacagatctgattatctctattcctttgcctacagataatattaaaacccttaactaattaggagtaggatcctaccattattcatctctataaggtcacagcctagcacataccctgccttctagaaagtactcaataaatatttgttgaataaattactataaaatgaataaaatctatgacaaagcaatgcatcattaactgtaactagtgtaatgccatgtctatatctaattctatttatagtttaagtattagaatcttaaagccacttgacagggtttgagtttaggcatttccaaaatcaatgattatataaggataaacaaaaggtccttatatgtacagaaggaaaaatagaaacctgagagataagcgttcctaaataataatgggcaaagataaataagaactaatttttaaataaacttgaaaacataagagatttatacctaaaaactatagaaataatatttaaaataacctatgtgttcatttgaaatcacaatagataaaatattttctaatttttaagtgtcaagttcacagtcagaatacataatctgaagactctaagctgtttctgcaactacgttaaaacagtttaaatagtaaaatagagtctagattagtattcaataaaataatttaaaaatatgcatcaggattgtctgtatataatagaattttagaaattagcgtaaatcatcctgagttctagataactaaagacattttaaatgtctttatgtggaaacattttataaacacactacaagtaaatcattttagaaagccatacctgcaaaagagttgttctgtggagctttagtgcccctttctggtgaactttagcaaagcatcctgaacaataatcttctccacattcaaggcatacctaaaaagatattttttaaaaaattatacaatcttataaaatagtatgatttttagaaagtgtttgcataaagatgtcttgttttttaatatttatttctctaattaaatacctatatcatcagaattgagaagcctgtcccaggcttctcaactagtcccttaactgggactagttgtcccagttaagacttaactctttgaagaaaactaattcgaaaacactaattattctcatatcaaaataaatgtagttttaatgtaggtttggggtgtatattttagatgcatggatgtatgcatagtttctgaataaactataaaacaaccagtagcctcaggtcaaacttcttgacctggtaaaaactaaacagcattatctctgggtgaaaactccttcatttgtatgagttattttatctttctgtatggatttacatgacataattagtttcaagtgatatgcatactctttgccctccaaaatccctatacacttccctggaaggtactcctttactggtggttctcaaagtatggctttaaaatttttcttacaagcatctctaaaggaaaaaaaaaagtataagaaaaaaatactagatggaactacattaccatgtctgtaatgttaataactgataaaatgattatgggcaagtttatatttaacttccaaattatgatgtttaaaaatgtaattttaaaattgttggacaagttaaataatgtaaaatactcgtacctatgatggtgccaagcaaaactgaaactaaagagaaaaggaaatggaaattggatgtcaggttcaagatggatgattaaatgcagcttgggtgtgcctttctatagacaggagccaaagtatcaagtagatattcacatttcaaatagattgcctgagagagaacactggaattcagaagagagatgatgggagacaccaagggtgaagaaaagagaaacagggcttcctgcttggggtcactgggacctggacccagggaaggagtaagtgaaggatttccaatgctcctcattcctaccatggacctctgcaatcctaactatggagagatctaggagccccataggcctccacactggcctagagaggtgcctggatatcacacagaggaatggctagaattcatgtgaagtcccataggcttccaagtgctgagcagctgcactaaggtgccattcctggagcccataccccaagggtctgagtcctgcccagagaccactggtgcccttcctgtctgcagggctggggagcaagaggggaagctgggtgttctcatgctctgccactactgatgcatgacctggtgcattcagatcaagcaccccattcctgtcagtctctcccaaaactgtctgctggcctttccattagagaatgttctgcccttcctggttgctggcccacaacatagccatcgctgacccaccagtgttcagctggtgacctgggatcagtccacccctccttatcacagccagctaagggggaggtatatagcatcaaatgcctatatcaaaaagatagaaagatctcaaggaacataaaaaaagagaacaaaccaaacccaaagctagcagaaaaagagaaataacaaagatcagagaagaaataaataaaattgagctaaaaaatgtaaaaaatcaacaaaatgaaaaattgggtctttgaaaaaattaatgaaattgatcgaccactagctagattaagaaaaatgagagaggattcaaatacgcacaataagatatgataaaggtgacattaaaactgataccatagaaatacaaaagatcatcagagactactatgagcatctccacacacaaactagaaaacatatagaaaatgaataaattcctggaaacgcacagcctctcaaggttgaaacaggaaaaaatagaaatccagaacagaccaatatgagtagtgacgttgtatcagtaataaaaattttcccaacaacaaaaaagccaagatcagacagattcacagcaaattctaccagtcataaaaagaaaaattgataccaataccactgaaactatttcaaaaaaatcaaggaggaaatactccctactcattctaagaagccagggtaaccctgctaccaaagccaggcaaggacacaataaaacttaagagtccaataccattaataaacatagatacaaaaattctcaaaaaaaaaaaaagctagcaaattgaatccaacaacacatcaaaaagatactactccataataaagtgggttttatccaggggatgggggatgtttcaacatatgcaaaccaataaatgtgatttaccacataaatagaataaaaacaaaactatatcatatctcattagatgcagaaaaagcatttgataacattcagcatcactccatgataaaaaccctcaacgacctaggcacagaagaaacattcacaaaataataaaagtcataagacaacaaaccccagccaacatcttactgaactgggaagtgtctaaaacgttgcccctaacaactagaaaaagacaaggatgcctacttttaccacttctattcaacatagtactggaattcctagccagaacaatcaggcaaaagaaagaaataaaaggcatccaaattggaaaagaggaagtcaaattatttatgtttgctaatgatgttatcttatgcctagaaaaccctaatggcttctctgacacactcatcaattgattggataaagaaaatattgtaagatatataccatggaatactactccactatgaaaaagaatgattttacatcttttacagcaacatgaaaggaactagatggaggccattatcctaagtgaaataactcataaacaagaagtcaaatactgcatgtattacttgtaagtgggagagctaaacaatgggtgttaactaaacacatggacatacagagtagaaaaatagacactggacactccatacattggaagggtgggaaaggggtaaagactgaaaaattacatagtggctatgatgttcccattcagatgatgggtactaaaagcccagacttcatcactacacaatatatccagataacacaacttcacttgtaccaactaaatctataaaaataaaaataataataataaattataacagagcagtgatattatatgttttatctcatttaatcctcacaacaactctataaatttacaatcacccttgtatctccataatgaagaagagataacaaaagaacataatgatgaagaatttgtccagagtcatacaagctaatagtggtggggacaggaattcaatcctaccatgtggctcaaagcttaaacccttaaccacaacaaacattactaatctttaaattaatcatttacaataaactaaaatagtgatcagttacagacactcttcaacttacaatgtggctactgcccaataaacccatcataaattgaaaacattgtaagttgaaaatatatttagtacaaataacctactaagcatcatagcttagcctagctaaccttaaatgtgctcaaaacacttacattagcctacatttgagcaaaatcatctaacacaaacctattttataataaattgttgaatatcttgtgttttttttaaccttcatgatcacatggctgactatgagcttcctagcatcgtattttaccacatatcactagcctgggaaaatatcagaattcgaactttgaagtatggtttctactgaatacatactgtttttacacatcataaagtcaaaaaattgtaagtgaaaaatggtaagtcagggaccatttatatcgaaaaaccttgataaaatccacaataaaataaaattcagtatttaaaaagaatgcatggtctggtatgtatcaaaatccaaatgtatgtttttcaagtgtgattagctaaaagatgatggaatttttacttaatctgaagaaaaaaaaacactatccctagcatagaaactagtcccctctttccattcttgtttcatgagcttcattcttctagagaaatgataaaaacattatcctaaatccgtaattttaagtgtaaaataaactttaaaactataattttatataaatacatggttatatcattatattaatatggatttcaaaatatattctgcataatttttatttaatataacttgctaattttaagtgaatttttcctaaacatttggcactgtttttacactataatgcagaaaactgaaaatgagtttcagcatataattctaagccaagtgtctgttaacaacatacttttagtaaaagtagccaaacgaatatttgtagactggaagatcaatgctggacttgcagagtaagcttatatattttgttatacaaggatatttggattaaaattgagttaaaatgacctccaattggaaaatctttttaggcagtttgtacaactggcagaaacatgctaaaaatgtaaataaggactccttcccaccacagatgcttcctcaatgatggaatatccaactgcagttttaacaaatatcttgttaatttgatgaatgccagatcagttgtgctaagcttcagaatccatttgagtttaattaaattattcacatttgccaaattaatatataagaaaagtggaacttttgggcttcgtctttgccatcaatatatgtaaatggataggtcatttaaaaatttgccaacaacaaaacacactgtttattgtcttccgtctatgtgctggacacaatgctaaatattttacatgtattaactcattacgtgtgataactttgaggtacagattactgttatccgtagtaacctatttcacaaatgaggaaacagagataaagagggattaagtcatttgctgaaggtcacatagctaataacaggtaaagttgagtttcaaactcccaaaacacaagcccttaactcctatctcccatacacaattttccctggtgaaggccaaggatatacatatatctatatctatatacatagatatatatatcctttatatatatattcatatatacacatatgtggctttcaaatatatatattcactcattatccagtcagcataaccatatgcaatgacagatgctaagaacacaagataacatcagagtttaacaataccatggtctacttcactaaatctgcctaatttgaatttttaaatagctttttattatgttttgacaactaacatgggatattctttttattcaaataaaataacattctttctcaaaatcattttaaagaatgtttaaattctttattctaaattctggcttgtctacacagtgtttttcaggtaaatcagctgtttaatcactgcatacaatgtcactctcctgtgctttccagccaaggcacctgctgcttatcttgtctgggacatccttcttcttacttttccttctttcttgaaaaacagatcctttattttcgggtcaagccctatctacttgtgtcatactgttcaagttccatggctcaagtgcttaccacagagtaggagtcacaaaaaatattgactcatagctcctgtataattcgttttcagatcattagaagcagatcccaacaatttaattcaacctgtaagtgccttttagctttcacacttttaacttaggaaatattagcatttgtttataatttttacaaatttctggacagcaatttttttaagattccttaaattactgccaaacatcatatcaaataagaaaataatataatgtaataagaagagtattctactaccaagagcgggggttttacatttaatattgttattagctctttattagatgtgcagcattcgaactcagagtccagttaaaattgccattaaataaacctaacaatatagatttaagtcagaaatgattatggctaagttctctaaaactgtaacataatatacaaatattagtatacataaccattaaattctttgaagaggaaactgctttttacctatgtgttatatttaaaattgcaaatgatgctgcagtaccttcaatgataactgaaaggaaaatatgtgtaaattaagagaatgtctatattatgaaatagtttcaaagaaataattcattcattaaatatttgttgagtgcctaccacactgcaggcataattctaggtggtaggcacacagcagtgaacaaaactacactcctaccctcatgaagtttacattgcagataagtagaaaataaataaacatataatcaatgatgatcaatattacatagacaaatgaactagcttcacaaaactggagagtgcaactcagcttttactattttacaaagggctatcaatgtaagtaacatttgagttgatatttactgatatgaggaaactgtgagggaagactatttattggaaaaagattaagggcttaattttgaacacattaaaatagtgatgcctattagacatccaataaaggtgttgagtaggtagattgagccaaaacttcaggggagaggtataaggtggatgtgtaaattaggggatgatcaatatagatagggtctttaaagccaacagaggggttgagattgctaaagagtaagtatagatggacaagattagagccctgtggcattccaacattaagaggtcaatacagaaaaccagcaaagaacagagaagaaacagatatcaatgtcaaatgaaatcaagaaatcatagtgtcccagaggaagccagctgaatgaagaaagtcatagataaggggagggatactgtactataaaatattcctaatacattaagaactgagaattgaccattgtatatgagaatgtggaagtcactggttgaccttgacagaaacagttcctggatagtagtggagacccaagactgaatggagagaattcaagagagaatgggaatccagtgattccagttctaggtatacacccaaaagaactgaaagcagggtcttaaagaggtatttgtacactcatgttcatagcagcattactcacaatagccaaaagggggaagcaacccaagtgtccactaatggatgaatagttaaacaaaatatggcacatacatacaaaggaatattattcagccttaaaaaataaagaaattctataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactattgcaagaacaaaaaaccaaacaccgcatattctcactcataggtgggaattgaacaatgaatacacatggacacaagaaggggaacatcacactctggggactgttgttgagaggggagggatagctttaggagatatacctaatgctaaatgacgagttaatgggtgcagcacaccagcatggcacatgtatacatatgtaactaacctgcacattgtgcacatgtaccctaaaacttaaagtataataataataaaataaaataaagtaaaataaaaaaataataaaaaaagaaatcctatcattccacaatatgaataagccttgaggatactatgctaagcgaaataagccagtaactaaaaggcaaatagtgtatgattttacttatatgaggtagagtagtcaaattctcagagacggaaagtaaaatactatttactaggggatggggggaatggggatggggaagtgattgtttaatggatacagagtttcagttttgcaagatgaaaacagttctgtgaatgaagcatagcaatgttaatatacttaatgctactaaactgtatacttaaaatagctaagttgacacattttatgttatatgtatttcactataattttttaaatgttcatgaaattggtaccaatgagaagttaaagagcagtcagaagtcataattttctgtaattttttcatttcacattatagcttttaagagaggatatatagtctaggcgtggtggctcacacctgtaatcccagcactttgggaggcagaggcaggcggatcatgaggtcaggagatcgagaccatcctggctaacatggtgaaaccccatttctactaaaaatacaaaaaattagctgggcgtggtgacgcgtgcctataatcccagctacttgggaggctgaggcaggagaattgcttgaactctggaggcggaggttgcagtgagcccagattgcgccactgcactccagcctgggcaacagagcaagactccatctcaaaaaaaaaaaaaaaaaaaaaaaaaaagagagagaatatgtcacttgtgagaaaagaaaaaaaagacatacacaaatgtccatagcagccttaaacataatagcaaaaatattgaaacaacccaaatgtcattcaatgtatgaatggataaacaaattgtgttataactgtacaatggaatactactccataatacaaatgaacacattaccaataaatttaacatggatgaatcatgtggagcaaaagaagccaaaagtatatactatattattccatttacataaagttcaagaacagatatcactaaatctatagtgttaaaaatcaggacagtagttgccttggtgttggggactgattggaaaaggcacatgagaactttccagggtaaaggtaatcttctaggtcttgatagaggtggacacattaatcaaaaggcatctgactgtacatttaagtccatccatctcatagtaaattatgcctcaatattaaaaaaatagacaatgggaggatagaatatgatgacagcaagtatagacaactcttcagaagagttttacaataatggggtgcaggcttggaggtcaaaaagaattgttgttgtagttttggtttggttttggttttggatgggatatactgcaacatgtttgtgtgctaataggtatgactcaaaggagcggagacaaggtctaagctgatgtctttaaacaagaatgagaagatgagattcagagaataagtacaggtattgactgtccccagcagcatgcatgctcaacccacagtaacagtaatgaagaaaaagtatatggctaccaagcaagttaagttgggagaggtgtatgaggccatgtgaaagttctattctaactgcttaatatacctactatacagtatatgtatatatactatataacgtacataccagtagagcagctttgttctcacactgtccacatactttcccatttatcttgggtttttcacattctgaagaatttgccattttataattaactgttggtttcactggctctgcaagataaaaaataatattactccaatcatttaaaaatatgttaaattttccaattgataaattaatgaaactatgcatacttcccatctctgtatcaaactgaagcccacatagaacaaattctaaacatttataattatatatattcataataaatatatgtatataaatatatattatatatatttctgaattttttctaccaaactatattaatcatgcaacatttgtgtttactatcctccagaaaaacatcttatttccttgggaattattataaattcaaattatatttttggttttgctattattaaataatttattaaaatataaagcaatttttctatttttaaaaattttctagagtgaaattttaatttataatttacactgctaaattatcttccttattaaaacattacatcaataaaatttaaggaacagtgctgtaaaagtcctcacttttgaaaaatactattactataatcatgtactaagtttacattttttgacacaaaagcccccctaaccacccgaataaaatttatgttgaaaatcaatgtgtcatgatttgggggtttagaatctttatactgcccggacaattctaaaactttaactttatttgtaattacaatgtaaaagaaagggatgtctttagcatttattaacatggtgataaattatttaccttgaatctgttccttcagcaattttaatttcacttttccagcagaaaactgtattaataaaatagatactatttgtcaggtatatattatcttattcaacgaaagttgccaacaaaaatattagaaagctgtagctttggtgcttttcgaacaaaaatttatttttaaagaataatataaaattaataggagatcatcattaaagcatatatgtaccttttaattaatctaatagaaattcataaaaaagaaaataaattttaaaaatatatctaaaccagtttttgaaaacataatttggcttttaaacaaaaaccattatatctcattatgaaattatttgctagtattcaaatattgtaaaggtttaatacatcttttctatttctgctctttctgagacacacagtctaatatttgtgtaagctgaatctaaactgaattgtgactaagctattctgcttacactactatagaaacccatattattttatttgcccaatttagagaactgcatgtgtaagcatcacagacttatccttcaaaagtattatttgtgatcactgactttcctaaatattagccaaaaaaaatgaataaataagattcactgctagatatttcaaataaatcatcacttaaaattttgggattttaatattttaggaagtaaaatactcttgccaattgaacatgcttgccttgatcttattaaaaccaacatttaaagtacacaaacgagaatgaaggatggtgtgcatttatatagatactgtcaattcaggcctagttttcaatttgcaatttgcatgctcaattgctcaatttgtacatgagaatctgagaacaatgactgcctctatatctatggctgtagcaactgcagtcatctgaaaatgtaggcctaattattctcagtgaatctagtggttttgcttcaaaggggcagttatttttcacattcttcaaagtaactgctcagatgctatgtactaaacacagcagaaaagaaaataagattgaaatcatcaatttttctatgaaccacacttttatttttaaattgctaatgttatacaagttacagataatctaatctcatttttcataaccaaattatccagtatgactaccttaatgatacatctgaattgaaacatgatcagtgtggttgtaggctaccctggatggaatggatagatatgcccaagcaaaatgaacccattattagggaaattgtataatttgtttttattattatgaataatattgttctgctctatgaatacagccatatttatttcaagtgattcaaactgcataaaaatatttcagtgaacaaacctctagctgctatttttagacaaatagaatttcctcataggtctgatttttatctgttagggaaagggttggaggtagggttgaaccaaggatacacatgcttacacaaacacacatatacacatatatgcgcatgtacatatacatatataatacatgcatatgtatatatacatatagatagaaagatggatatctgcatatgtttgtatatacaaatgtcaggaacttaatatactaaagcctatgccttattaacatgctgactcctccaccagtaggtattgaaggggtgctatcaggggccaggaaagcttagtggatttaccacacagacatattatctatgccactggggtcagaatatgctgtcatcatcagcctccctggcattcacaaatacctccgaactcccaccaatgccttcatctgccacactgagcccaaacttctcctacagtcatctttcagacgttctcactgtcaacccagttagctactgaaacttcgcaattctgtactaattgtccttccttccaagcccccactgccattccgtggatcttctattaaatagtcatttatgtatcttatgctttaaacctttcccaaaaatgtttcatcaaaagtttacatcaactgaaagccacctttgcttagacacaatcttcaccaaagcacttcccacaggacctagcccctttccacttcctttcacataccaggaaagagaaaatttttctatttgctcttcagtgctgtttccagaatattattgtgctatcatgattcagcaaaggtgcctctactataggtccccaccatccacttattgcttgtgtcaatatctagggtctcttccacctgaacttcagcaacctgctcggtatttctctccatcacatttctgcttgacagtcttagagacttcaatgcacatgttcacctgacatcctggtttgaagaccctccaacatgctggctactgtgaacatctaaatgcctcttcagccacctcaccattataaccaaatctggcatgtaagcagcattctgaatagccacaccttcaaaatctcagactctaaagtttttcagtgccaacctcaatcaccttatctcttccttctgatgcctccaatatctatgtaccactgtgataaaaataatactatagagcctcctacaaatccatgctgatcagcctcaatgggctatatggctctttggcaatccatttactcatttgctgctaatccccaaccacaattcccacagtggctactccaaacctcttcattcccaagaactcaaattcatcccatttcccttaattcacctgagcagacgatattgtcttcaactgtcctaagaaagttgaggtcttcccattaaaatctttcagtgtcccacctcaccacttgtcaaaaacaatctctaaaatttattttcattgccacctgttttttcttccacctttcttgtctcacacacacacaaaaaatatgtcttcctttccttggtgaaggcctctttaatggactacctcttcaaagaccacacacccagcaactggcacctctttcatctacattttgactctttcctctactaggatgtccatctttcattctacaaactggcccacatcatcttgacaattctagaaaagaatataataaagtctttccttgattctattaaacccttgaaaggtcaccaactgctttcatgctggctgcaacaatagtctttactcattgcttcccaccgttttcttttcaaccaattgaaatctactctcttatttaatattgacacaatcatcaaatttaggtcttttaaatattttcattatccagaaatagacattttaatgtaatgtttaggtatcattacaaagtggtttcacatatttcaagagtttttgacattgctcaaaagctctttgaagtggttagtaggtattattatgcaagtttacaagtgtagtaatagaggcttggaaaggttaagtgaatgttaatctatataatctaatacagagtttctagacctcagcatcactgacatttggggccgaataattctttgttgtggggattgtcaagtgcattgtaggatgtttagcagcacccctggcccttactcactatatatctttagcaaaaaaaaaaaatacgcaaaaacaacaacaacaacaaaaatatacctctcaatgttaacaactgaaaatgtctccagactttgtcaaatgtctcctgggaagcaaaattgcccccttcagaaacactagtctaaatagatactcaaaacttttttcactacacaatatattggacattattgacttcatattttccaaaaatgttctcctttactttcgtccttataacattgaactacttcgattttacttcgccattctttttcttctcaatctctcttcactagagagctggcaaattatcttagacaagcctgagagcttacatgtcaaatcttggccctgacttttgaccttgagtgagttatttagtttttttttatattaagttatttcatctgtgaaactggaataataataacatcctcttaggagtgatataagcacttaatgagataagaaaggaaaagaagcgaaactgttgactggtattaaaacttattgagcttattgagtgaatattaaagttctctttgccaatatagtttacacactggctttctttaagctttattctttacacctctctatgttttacaaatcctagggagtacatttactcccttaacttcaactatcacttgaaaattcaaacaaaactctaaatgtataccccgtacttttctaagtcctttctttatgctgtctcttagtcaatccagcctgtaatatcaattatatgtttgacttcctcctctcctttctcactgttttatggttccatatttttctttatatatgttttcctacccttttaattcagcctcctttcatctgacctctagattattttaatagtcttacaaatagcctgtttctagtgagataagttttttttaaacgttggggtcaaaacttttataattgatttttccctaagatagggaatgacaccagagaataaaacgctttctcaaagccaaaaactttagaagcgccaagtaagatctttgtagattccaactgacccaatgaaagtttaatgataggtacgtaaaaaataaaaactgtgtaagctaatacttacaaagtcacgaatcttgcactaaagaatccagaagcaaaattgttttctttatgtaaagacacttatctgattttcatcttaaatataatattatattttatagcacacagtaaaggagcagcaattctatagctgggaaactgaaaagtatttttttcttgagtatctttacacatggaatcaacagtatatgaataataaattattattgaagcagaatataaaacattaaactaatgtgatataaaagtaggaataaagtctctcatttgttatattaaataacaatagctttcaccttagtttagaagtatttagttctattttatatactttaaaccagatccacactgaatggaaaaattcagtttgggatgtgggaaaattcactgcaaggtaaaattttgaaatcagtttgtagctgaaaaacaaaaacataattgaataatgaaagttgcatattaccctgcaaaataaatcaacaagtgaataatatgcaaagttgttaaaataagaagagtatattcctgagtatagaagaaaatgcaagacctaaaaaagaatatcttcttgcttagcaaaatgcataagaatcaaatagtatcttcttaccttaacaacatttcctttattttgtgacatcatatatgattgattgaccaatttgcccacttttccagatttccagtaatactcgcttgacctttaatatatataaacaagataaaatgtaatcactaaacacatttctccctttaatgaaaagaaatacagtgttcctgtttcagaaaatggaaattcagttgttaacatgcagtaaacaagcaaaacatgaaaaataaatatcaataatgtcacaatatcctcagtaattttaaaatgtagctttatcatatttatgacctttgtggagaaatgaataaaatgaaatgtccaaacacaaatgaagaattctatttccttgatattcacaatgactaaagatagctttattgatttgtaggaaactttacaggtctttatgaaattttaaaagctaaatgtccacaaatgtaaagaagaaaagcaagcaaaccaataccccaaaatattcagtggatctagtaagtgatgaattccttgttaaaacctctaatgatctcccacattgaaacataacagagattacaaagaaggcatactttagctgtacagtttttaaagcacttgagctttgtttacttgagcataacaaaatatttttgaagttatcaaggcagagagtccaattatcattaaaaaataacaataagacaaaaagttgcccaacatcacacagaataaataattaagattggagcactagacttctattttcctggctagtgagtggcaggttctcattctggctatgacatttaatatctgtgtgacctcagaaaacaatgtaactattctgaaaactcagtcaagctttagaatgttaagaatcatctagaaaagcttccacagctaagaaaaactcactatcagggctgattccagcaactccgattctcagatgagtatcatgatccatttagaagtccaaactaagtccaaatcagtgaaggtaaaagaattggccactgggtcattaaaagcagcaagacacataataaactttgtcatcctggatgacatacaacatgagatgctctgattaaaccaatgctctattagagggggtatgtatataagttatgcatatttttcaaagaaatggactctaaagataaatactactgaaagtataatgaacacatttgaattgtcattaaacgttaagaaggtacttctaggtatttgatggtcatcactttgaggactaaacaaaagttaatttaatatacaaacagtttggtgatatttagtaccagcaaacggacatgaaacatgcactctcatacactgtaggaaaagattatgaacttttgacacctatttggaagacaatttctcaatgtctatcacaatgtaaaatgcaaataacacattgacctaaaattacagaggtaggaatttatcccacaaatagctttgcatatgtaagcgaaaatacatgaagaagcatgttcatggcagcatttataatcataagatactaaaaacataataaagatctgaaaaataaatgctattatatccacacaaaaaatactacgtagccactaagaaaattaggctaattttcttatcacatcaatgcattctgatgtgataggagcattaagatatattaagtaaaatagtaggacatgaattaattcccatatttttagatgaactcatttgtaaaaaaaaaaaagtaaacgatacaatatatgcaacagatatactcactgaaaacaaaatacattcacacacatgtatatacgtatacttacacaaagataagacatttgtggagaaaatttttagtcattaaaatgggtgctagaaaatgggctgggagttagcctagagctaagaagagagaatttccatcacataattattagttctgtttgttatcatttatattattttataacaaaacaacaaattcagtataattagtacaaatatataagcataatattagaaagttctcattaataaaatttcagctaaccagcatttgctaaatatattttaaatatacataagggtttgagcaattctgattatatatatgtatatatatatatatatatacatatatatatgtaatagcatttatttttcagatcttcattatgtatatatatgtgaactcttgctcccaaaagcttttgaatacataaaaatggctctaaacataaactggtgtttatttgttattgatggcaattttctgagagcaaaaggtaaagtgtgcactgctgtcataaacattccagaccataaatcaatgagaagccaaaagttaaataaaaaggaaataagaaaggataagacccaataatgttcagaagaaacaaaagtaatggtaattttaaaaagcaacatgtctcatctaagtggcacaaaaacaaaaaatagaaggcctttgctattgctcgttcatcaggaaaagtcagaaattatccatccattaaatgtttttattggaatgacaacagtatataaaatagttctttatataatttagttgattcatctaaaattctctaagagtttcactcactctctatcttccttttctttgtttcttgtggatcggaattcttgcagtttcttctccatctcttggttctcaaactctaactgtactttctccattcgcagttcttgagcatttctgaagacataagatttaaatggagaaagcagaaaaacaagcgaagccaaaataattttatataatcttttcctgttaaattagaatcatgaataataaataaaatattttacctatttcttttgtacttctccgaaatctggtttttaaagttagcatttgccttccatcaaaatcctgaagcaaattatctcttcaaatcttagacttttgttttaattattacattgctaggggttcaaaattataattaacttcatatataaggcatgtttttatatatgaacaaatatctatgacatacaaacagaaaacgaaataaaaatattgtccaattttcatattgttttgcctccaatgtagtcaagtagtttgaagcacagtatttaaaacaatagacgaaatatacatttttgctgaactggtcacctccaaaattttaaatctctacctttatgtcatatatgtatgatgaggaggaaaaggtagtacctgtttgagacctattaagaataaagcccctattaacagttttggtacgggagcttcctgtacaagagattttgataacatctgaaactcactaagtttttgacaaaagacattttcttcattttacgaagtctggttatcagtattagccaccgactctttctttcatagatctaacccaaactaattctctagcttttactattgtaagtccaaatctcttccttcaatattacattagtgttttactacaatcaagcagtgtgggcacccacgcatgctatggcatggaacaaaatcaaggcataataaagttcataaaggagaaatctttctagaggtagcaagcaattaccaaaaagcaagcgggccaaggatatgtcctaagcggacacaatcgaggaagatatacagaaagtgataggaagggctgtccagagggttcagagaagctggctaagatacagaaagagaggcatttatttgcattgtatctactccacaatgagtaatgcagctactacctcaaacaaacactgctaggtgataggatgtgaaatacaatggagcttccagtattgagaggaatagatgagcataaaggtaattgaaatatagtggaatagtgctgtcattggggaagtacagggggctacctgggcacaaagaaacagcacataccccagccctgtgaatgcaggaacagttcctggagaaggtgaagtatgagctgaaacctaaaggatgaaaggacttagccagtcaaagggaagtgctgagtgcagtgttccagaaagaaaggagtgtggacataggtagcaaagagcaatgggtgggtcaaggaactagaagttctctgtgaccagacattaagtgcagaataggaaaagtagcaaaaaataaaactgctgaagtggataggatcatgaagagccttgtaagccatgatgagaaattgggatttatattgtatgaacaatgaggatcattaaagggttttaagagaattgatcagacttacatttagaaagatcactcaggctgtatcaaaggaaatcaattagagggtgcaaggctagaagcaagacaaccaattagtagactattccagtaatccaaataatagagaatttgggctagtctgactgagcaggggcaatggagagaaaaatggagcttttgagaaatttaagaagatataattaacaagttggaaactgaccagaagtaggtgactgattagagagggaacaaggaagaaatctaaaataatcccatgtttcttatttgagctgtcaggaggacaatggtgtcttttcctgaaacagaccattctgaaatgggccacaggtacagttcaggatgagtaacagtttatctccatgcttaaagtcttgaaagcctaccacacttcacaaactgcttacaggagaagagttaaaaaaacaaatatgattgtgtcactcatttgcttagaagacttctgacgtttttgaagtcccactgtggtagaggaaaaggttaaggctgtagaaaaagagtggcctactgaccaagcggtcaagtttatgcaaggttggattgtatggatctcacacaaaacagaggattccccctggagacaatgttatacacggagccataaagggaaagcaaggccacttgaggaaagctaaggttgatccttagctttatttatttaatttattgtttaagagatttctttaagatttccaaaatgataagttcagcaaaaatatgtatgttgcctatatagaaaaaaaattgttattttaaatattatgcatcaaactacgtgattagaggcaacacagatgatatgaaaattagaaaataatttctaatcaacaaaacaaatccaagggctagaaataagattgaaatggtttaggggctgagaaagaggtcaggaggactggaagaacaccagaatgtcagacaatgtaaaggcaatgtccaaggagaacaggcttggaacacggaaaaagtgagaaagagaactctacggtaattactgtgagtgggtattcctgtcctggtttttaatggtttgtggatcagggagacgtacaggccagggaatagtgattccaacctatttccaaactctttactatgacatacacattagttatcatctagaccctgcctttttctccacctttcttcttagacaattggatatgtctgagaagtccccaaaatcatgtggtctctgagaagtccccaaaatcatgtggtctctgtgtctttgcataagtttcacccaataactacccaactaactgcatctctcactcagaacttgggtacctcctcactcctgctctagcagtttgagccatgttctctcctagtcccttgcctttacacatcacaccatgcttcattctatattgtcagtgtaactgtactcattcatattctctctaagctttcggagtgccaggactatgacttcctgcttttgtagccatcattccctagcacagtgtatagaaaatgcacacttaattaatgtttgttggctaaatgtttacaggtatagacacgtggccctgaaatatgtcactaaaatcaaataacacatgtccctttttctttttctattaacaaaattggtagtcctagcaattagatagctcccctccccaccaaatacatggtatacctaaaaatgataatgccatatatttttataacatttccagtttacacaatacttttataccccatatctcaaagtgaagagagcattagaatagctttgaagacaccaaataaccacaaaactattgatctggatcaaaaaactcagaaactccaattaaaaatgatagtctgggctgggtgcactggctcacacttgtaatcccagcactttgggaggtagaggtgagaggattacttaaggtcaggagtaaaccaacctggccaacatggccaagcaccatctctattaaaaatacaaacattagccaggcatggtagcgtgcgcctgtaatcccagctactccggtggctgaggcaggagaattgcctgaggccgggaggtggaggttgcagtgagccgagaccgtgccagtgcactccagcctgggtgagggagcaagacttcgtctaaaaaaaaaaagtctgtcttcatcctatgctggctggctcttactgatattgaagaggaaagccctaagtatttccagtgactgtaggtgacatcaaagacaaacagggagctatactctcccatacccctgcaaggtcataaaattcccaggatgccagtaattgtttggctctggctgaatgcatctcccagtcatctaggacagacctctcctggaaaaggtcaattcaacataacatcctttatgtaaagggctaaagtatgtagtgctttctatttcctggttagggtctcttatcctaatagtctccctaaatttcagggtaatccttacttaactttgaataagggccatgaaaaatatgtttaacattctgttgtattactttaataggtaatgaaccaaacctttataacttgtcacattggttcttgtggaataaatatttttaatcctcatttttaaactattatagatttatagtatttcaaagctatattcttatagataaaaatacaggaatgtgaaaaatgaagataagaattcacaaaatagtcaaaattacaatatacagaagctttgcaactattcctattaagaaataaatatatatgaactcacctatattttagctttacagaatttccaggttttccccatggaagaactacaaaatcttttctgttcatgattaccaccttaatattgtctaaaagttattctgatttgtaaacacttctgtaaaagtaacaaagacaaaagaattatggcagaggtgaagcagtataagttacaaattcaaaactccatataattcaggaatgtttttaaaaccttatgagcaaaaaggctgaatcaaaatttaaacagcaaaaattatacactgttagccctttgtccccttcagccacatatcaaccagataatcaaaaatattagaataaaaaatacaaaaaaagtacaactatttacatagcatttatactgtattaagtattataagtaagcaagagctgatttaaagtatacagtaggttatgtgtaggctatatgcaaatactatgccattttatataaggaacctgagcatcctaggattttggtgtttgcagggtgtgagggagttactggaaccagtctcctgtggaaacctagaaatgactgtattttaagttatgtaactatttatgtgctaataaagttagaaatgtaacacgtctgatggaattaaaatttcaccaatatttatgtacagctgacccttcaacaacataagggttaggggcaccaatcccccaaaaatctgtgtacaacttctaatttcccccaaattttactattaacttattgttcatcagaagccttactgataacataatcaatgaatatattatgcatgttatatgtatgtacatactatattcttttaaaaagtaagctagataacagaaaatgttattgagaaaatcataaagaagagaaaatatatttactatttattaagtggaagtgaatcatgatcaggggcttcacattgagcaggctgaggaagacgaagatgaagaggagttggtcctgtctcaggagtggcagagatggaagtggtagacgacatggaagggaaagcaagagggacaggcacacaagtgtaactattattttttaaaaaattatttataagtggatctgcacagttcaaacctatgatgttcaagggtaaactgtatagcaaaagactagggaaatagtcaactaaaagtgaaggatacattcattaaaacaaactaaagcacatattctggctctttctattgctaaggctataaaagtataccaagtatttgttctatctaaaaataatatccaaggccgtgcagagagaaacgaaaagaatctttgagatacaatctaaacccaatatcctttttatatatatatatggttatataaaatgaaaattaaggtatgtaataattacccaaaggcattctaatatcctcatttatcaaagaaaattttaatgatactctttggctcagatcagaaattagcatattttagaaagaatttttcaacaagaaacaaaaaggattttctgcttaactttgagttaaccagaaaataaaattattcagaacaccctgtttcccaagtatcccaattattcatggttctataataatttactctgtaatgctgaattactaaatcacatgaacaactattagatttttataggaataaaaatttccaagttctaagagcttttaaagaaatatgagtcaatattatagtgaccatagacttaaatgcccacaccatttgatgctgtcatttatatatgtgttcctatgtgtgtgctcataaccacaataaacatttattaaggttctgctatatacaaggcaatgtgctgagaggtatggagaggagtcaaggcccagggaggtttgttttctgagctcaaatggtttagagtcaaatagggcatataggaccctaaatataaaagccataaaacaaggtaaaaattataagggctataaaatttatacatgtgataatataggaagtgaaagaaaagagagaattcagctggctagcatttaagtaaagctttgaaggagaaaggaggcttacagataaagatatggattagatgaacaatccatactgttggaaagaatagctcttggataagggactaatgaatagttacacttgcttggtgtgcaggttacgtggaagaaaaaaaataaacatgagtttagatatagtggctgaggcccaataatgagtggctttaaatgtcaagtttatagcatttggaatttattctgtagctaacaagagtctaatgggatttagcagggaaaacgtaagtctagaagctttgctctaagacttaaggaaggacagcaccaaaactggagttacctaataaaaggctattgtgacatcaaagtctacacaaccaaataagtggttcttcatcgttgttcctttgggagactatcttatatttcaacgatgcaaccactgattgaaaacatttttgggacgcctcttttgaaactgtctagagaatccattttatggctggacgcggtggctgacacctgtaatcccagtaccttgggaggccaaggtgggcagatgacttgaggtcaggagttcgagaccagcctgactaacatggtgaaaccccatctctactaaaaatacaaaaattagccaggcgtggtggcatacacttgtaatcccaactacttgggaggctgaggcacgagaatcgcttgaacccgggaggtcgagattgcagtgggccaagatcgcaccactgcactccagtctgggtgacagagtgagactctgtctcaaaaaagaaaaaaaaaagaatccattatacaccaacaaacacacaaattcatcttgttgtgcctcatttgaaattaaaaatgattgtgcaataggagcaactatttttttttcactcaaacctacctccaaattacttggactatctccaaaaattaaatctaacctgaaagggtagatcttcaccattttggaggaaattctctaggaatttattctctaaatataattgcaaaatggaattacacaaaataattactacattttaaataaggtagcggttgccttatgggactagttatgtttgtaccttcaatccacaaacatgtatttaactgttcctttgtgatccctattagtggtcccaggtattgaagtcatgatggcaaataagccgtggtgtcttcccttgaggccctcacaatcaaggggaaatccacaaaagcaaccacaatatcatggggcattttgatagaagaatctacagcaggcgtctcactcagactcaattttcaaccaccaagtcctgtctctcaaagctaaattaagtgtcaacaagaaataaagataccataggaatggcaaactaagatttggtttgctttttgggagggaggtggtagcattttcaaatgtaattctcttttttctccctcatttttgtaggtagtatatttgtcccattttcatcaaatagcagctaccaaaggcacctttcaaaaacctccaggaataatcctgctccataacatggaatctgtattgctttctgatcatattcagggaatccaaatactggcctcttgcctacaattgataactttgtcacaaaaacttccataatgttattattatcattaaagagataaaataatttccaaagttaatctgtctgattattaaaataatctaaataatctaaattgctataattttgcttacacattgagatatacaatataattttatgtgtatgtacatatataaagctaaactgatatatgattgattttactgatacaaaaaatgaacgaacttctgtaaatctcattacaataagatgactcagatttatagctctgctgataatgttatttaaccaataaatggtcttattcaagggggatttcacttcactgaatgcaattagtaaggcttcttctcaattacatattttatctagtcacctacataagctaatttccttgtatgaagaaaaaggggagattataattctgagtcatattattctgcctgtttccttttgtaaagccaacagagaatttagtcacctttctggggatagcaaggatataacaatgtcagcagcaagaatagcaaagcacaaaattttagacacctaataaaaccagaggaatacagataaactccttactatgcaaaacttatacttccttgtgtcttttggtcattcagttttttttataactaaataccaaaaatttagtagtgatttggaaaaatttctagttacctgatttattagactacattatttttctgtctacaaccccatttttcctcacacaaaatacccaatataacccaaaattgtccatgatggtttgatgatccttctacacatgttcctattttgagaaagcaacccacacatcaaaacctactgccacagaatggaaacaaggaacgtacaatgctctatacaggtagaaactcagagcattcagccagaggtgcaagagaacaccattggcagaatgggaggtttgggaaaccactgtttacaagatgggccactttttgtaactgaaaacttatctaagtttagttaattcttctaatgactcagatcatgctaggcacaagacttaaaaaccataccataaatagggattttcccttactgtagcaatattttgaaatggtctaattagcaaacaactttgggtgaattaacatgtttaggcatttagtaccatagtacttagaaatcagagacccaagaaagaaatgttaaatgagaatttaaaatagttgcttttaataattaaaagaattttacttttcacatttcttctatctgtaattatccttattttaaatatatatattttttaaaatatttaaaaaattataaggcaagaactgataatacatgatttctagaatagtatcttgtgctggagtgtcctactaaataaatgtgtgccacattctcatagcaaaagctctaaaagtaaagcaggtattgatatagtttggctgtgtctccacccaaatctcatcttgaattgtaatccccataattcccacatgtggtgggagggccctggtaggagataattgaatcatggggacagtttcccccacgctattttcgtgatagtaagttctcatgagatctgatggttttataagggctatcccctttcacttagctgtcatccttctctttcctgccaccatgtgaagaaggatgtgtttgctttcctttctgccatgattataagtttcctgaggcctccccagccctgcagaactgtgaatcaaacctctttcctttgtaaataacccagtcttgggtatttcttcatagcagtgtgagaatggactaatataggtattgacttcaggttgcattcaatctttcagccaaacaagatatctgatagtaaaatactgcttcaaggtgctaaatggtacccaagttgcccattttttatgctctataggcaggttctcttgagaacaactgagaaactttgcctttagatatcaagggacaagataccattttaaaatacttttgattaaaaataataaacaatattaaaaggcactgaatttaaggtcagaaaacctaggtagactaaattcactggatttaaagtcataagatctttgtgtgatagaaatctctgagcttcagcttatccatgtagaaaatggtaaggatcctctccccctctaatttgcaggatattaaacaaaaggtgtctgatttgtgacttgacttgtcaagctgtgggcttctataagacctccagagagctcacggttcagggaaaggggcagccttagaaactacctagagaaggcacagccttagaaactacctagagaagaaaatggagcatcaagattgtgctttacccttagcatctctgctttcatcttttttacataatgagctttagtgtttacctctctgctcaccaagttttattctactcaatgctcaattcgaaggctgcctgtatcatgaagattccctccatcgaaaccgagcttctccttgtatagaaagaccatgtttattaaactcatttgctattgtatgttaccttgtgttattttttgcatctttgtttatatagattttgtttccctaagtagcccaaatatttgagagtggtcctaccattgacctttgaaaccccagcaatcaatacagtccctatacataatgtagtgccaataataatgtgctaagtatgtaattttttttctactgcttttagttttttgcacaacctaccctacggaaaaaattaaacacgccctctttcccacttcaactaaactttttgttttcttttttccatgtttcctaacgatcttgatgagcaatcaacaaatatacattgaacactctctccctgccaggtgtcaggttaagcactgaggatcaaggtcaaccagacaggtataataccagtcttcactgaacttacactctggtgaaggaagtaggtaaaaattaaaaagcgaataaaataattgcaagaattattaagtgtcttgaaagacataaaggaactactttcaaacaattcatttgtaatacaattggtaaaattatgacaggtcagggcagccctctgtgtagactataagataagctaaattggagaaaggcagagggagtcattacatttgcataagcatacagtttgtataattttaatcctgtgtagtttcaactttactatattttttaatgagccttgttaactttagattttaagtcaagctataaaatatatataactgaaccttacatacctgagtccctctactgctgattttgggaagaaaaaataaacttccacatcttcagatttctcaggaatcgggcaccccgcaccatagcccttacttgtgaggagtagacttcaagaagtaagtgggtgcatgtgaacgcgcaggcagactaaaggctacaaaaggggatgaaatatggtttctcagggtgccaaatttttcataaggtgcaaatgacttcaaaggataaaaggggctagtatttgaaagggtcgggctgcagaaggggtacaactgatgaagtccccaatttcactgtctggggttcactcttgattcatttatccattagcattttgggctgggaagtctttggtgtataccaaaggctttcaactcctgaggccagggccccgtcctgctgcctgcaggcctggcactatgtcagcctatggcaggggctcagcaaacacttgctgggccggtgcctccagctccacccgagctgagtctgcttcccagccgcgctgcccgctctgctccccgcaccaactagcccgggcttgctgcccgctaggcggactcagagaccatcctcccctctcatccacccgcagacagacaacccacctggagaccccagcctctcgcgtcaccaccgccggatggccgcggatagct

SEQ ID NO: 1100 - DNA, 139995 bp, Homo sapiens
ttatttttggtcctctttttttcttttattgcaaatttttgaagataccagaacttctataaatgttaaaaaccagaaaataaacagtgtaattataggttcaattgatgatactaactagtgtgacttggctgtcaaatgcacactcttgttgatgacataattatttaaaatataattggacgatgaaatatttctttaagtataatcatgttctgccctatagtaggttttatagacacagttgtaacagttatttcttcaaattcaccatattttactaacataatctgcaatatagattagtggttgacatataatatatcattggaagaataagcccttgaacttataattttacttttattagtttgtagccttgaaacatcaaagacattagtaatcaaaatctccagcacttggataggtaatcacttggttacttttctcagttgtttgctttactctgggtacaaaatggaaacagtaatgaacaaataatctttaagtactctttgaccacggtagtgtgatgacatgttgcttgttgagaaaatcttcctcctcctcatctgtactgctctcagaaagtgacagcaaagactgaattttggtatctcttccagaacagctgaaaatacataacaagatcaatacacaatatacagaaccgggtttcaactcttcatttatcttctgatcaatactacatatgttggagttgctggaggcaagcagatgtgagggagctgtatcagactggggccataattttcaatgtgcccaatataccaagcctccttttaatgagaaattctcatcattctccctctcccaagaaatacagccacagtagaatcaaggagagactttatggtctctgattgtgtcttttgttgatgattcagaggcactttagaaacctgcagagcctcagggtcatcattaagaacattcatcatcacattggctgtttaatagaatcccagtgaatagactgccagataaatcatctcttttgtatactgtaaattaggactatgtagatagccagtcaagatatgctgaagcaaaaattaatgacggcatttgtttgttattttattttgttgcattttattggtggcagcagggggcaccttattctgttagtaaggtccccttatatttttagtattgaatgtcatttgttttatgaatgatgagaatacttgtaggtgtagtttgtttttaatgatttatctaagggaagaaaatatcaatcttacattgatcctttaaacaaatataaatgataatagaaatgcaaaaatccaggctgagtgcagtggcctgagtagtcccagctgtttaagtggctgaagcaggatagcctgagcccaggagtttcagacctacctaggcaacatgttgataccctgtcttaaaaaatttttttacaagagaaagaaatgtaaaaaccaagaacaacaactcaatgatttcctcttccagaaagaataagaaactcctgattccctttttactgcagtatcagatttcaattaaatttcaatcaaagaaatttacaatacaaataacttattttatacttattttagtctttctagaagaaatcctgctccttcttcaaggaattgcagtgtgtcaataatagactgaaacaatagactacttttctgaaacatttactagtataacctacattccttgtaagctgatctgaccatccctaaatgtattttatgtgaggaaagaatgatatcatacaaattaaaatatgttattgttaattttctaggcttgatttcaagaaagaaacttactatttgattctaaaaaccttattcacattgggtaggattctattaatacaaagtattgacatttattaggttaattaattcaaataaggccattgattttcaatataataagaaatgctgaaggattattatattccaaatatcttttcatttttatgatacatattgtacagtagagaatgatctcttcacattaaagtaacaactttataagccttttactaaatctcgataatagatcagcaaaggacccaaacattctataaagaatgatcatataaagtatacacatgaggacaatctttctatatataataaagataactagttggagcttgtcaaaattttactacatactatattaataaataaactgcaggcttaacttacctcaattcctcaactccacagggacccctcacatgtgaggtcttaaggaaatctgtggaaatctgacttatattcagtgattggctgctgaaatctgggaactcttctgaggttaagctgtaaagcttttctgaagtatctgaaatattttatttcatgcattgtcaaaacataaattcaagaaacaaatatacagcatatggtgctgaatgtttacccagagtaaattacaggcaatacaaagaaggtcagcatagatttttaattattcctcaattttctaatgtttgtgaggtaagtttgatttgagattccaaattggggcatgggtagcaagtcatttttatcatattgatttgtaaatatacattacatttataacatgtgtcaaatgtcctgagacctcataaaatttcaaaaaaaaaatcaaatgaccccctttaaagctacaatattttgcagccactcaacctgttggacattttgttatcttttttcttataagaaataaaagctttactcccacacagtctaagggaaagattagccttggcaaagttgctctttcttttttgacttccttgctttgtttgagtagataataactgttcatatttgaaagcagagaagccttaaatttttcttttcatgaagctggcttatgatttagcctagctaaggacaaatactgcaagttaaacaaacaaagtctttaggcaaatgtatcttcatataaactaccaaaaattcaagtatgtaactaaatatcattgtatattagaaaggctacaatgccttcttttttcactgctgaaattataatgagccacctaacttatacataaagttatactatgatgactgttaaaactgtcaaaattactggttgctattcttcccttttttttttttagacagaatttcggtcttgttgcctgggctggagtgcaatggtgtgatcttggctcaccgcaacctccgcctcctgggttcaaatgattctcttgcctcagcctcccaactagctgggattataggcatgtgccaccacacccggctaattttgtatttttagtagagacggggtttctccatgttggtcaggctgctcttgaactcctgacctcgtgatctgcccacctcggccttccaaagccctttacttttatgagaggaccaaataaacctcctcctggtcacaggaaccaaacatcaacatacatgtgttctacagtggacttgacttttttttttttttttttttttttggtggttagtatcaacttgacatttttgagcaaatagagatttccctactgaaagtaaatcagattattcccactgaaaaatagacctcaataaatttacacatggaagtgtccctaaatttgtttagccccttgactttgaaatcatgatgcatgggtacgttcaataagcttaggatttggttcctgctcccaccatatcctcagcaatcaggactttacctgatctaaatttaggggctctatataagattaattttgaaaaagacaaaagattttttagttaaaattttttaaacctcctaattacttccatcttcacttagagatcagggaattatgggcccatgaagaactaataacttgctgaaagtcacacggccatatagtggaagagctgaaactagaactaatctctggtagctcaccaatattgtaaatcactctgttccagaatctaattctttagctttaagctattatcttctctcctatttttccgtatggtaaaagaagacccaaggcacctttacatgtcctaatgaaagggaatgctcccacaagaaagcagtaaattcaggatttggaactggtagaattacagtactgaaacccaacagcaatgctttgatctaaagaataccagcaggtgagatatccaaactctattatgcatttgagctaattgaatgagcataaagctgttccgagttgtgcaaatagaatgagtctatttttctagaactatttattctcaaaattatatttcagaatacctgtaaagttaacaggaacaaaggtgataccacttgattttaggtaacagaaaaatcaaggcagagaaaaataaaactgctcataacaaccctattgtaggttagtgttaaactcaaaaggtcaattgtacacaaatctgtctgctgatttttctaattcagcaccaggtaagacaggattaacatttatattagaaaagttacaactggcaagtcagttgattgttgagaaataaattatagttaaaccttttctatccctggagtaagagtaccttctctgatcattgaggaatctctttaaaaataatagcaattagactaaggagaaaaaaaatagataaaatatagagttctaaggtgcatttctaaaactgaagtcatttaaaacacatacataaaactatattccatagataaataagcacttacatgaaataaaacactaaagaaagaaatataaaaacttcaaagaatgagaaccaatcagagaggctatttcccaataaggaacaacaacaacaactctaaaggactatctagaatagctacatatctacatcctaatattaaagacagtgtgggccgggcgcggtggctcacgcctgtaatcccagcactttgggaggccgaggcgggcggatcacgaggtcaggagatcaagaccatcctggcccacacagtgaaaccccgtctctactaaaaatacaaaaaattagccgggcatggtagcggacccgggaggcggagcttgcagtgagctgagatcgcaccactgcactccagcctgggcgacaaagccctatttctaacctatttctaacactttagccttccttaatttttattctttccatcttctctcccctctgcactatgtcttgtttatttctccttttcctattctctccatgcttgcatccctttaccttcactctgcccacaccctccccttcttaagtggtgatatggtttggatttgtgtccccacccaaatctcatgtcaaattatcatccccagtgttgaaggaggggtctaatgaatggtgacatgatcatgggagaagatttcctccttgctgttctcatgatagagagttctcatgagatctggttgtgtaaaagtgtgtagcacttctcatccaccccttcctcctgctctggccatgtgaagatgtgcctgcttccccttctgccatgattataagtttcctgaggcctccacagccatgcttcccgtgcactctgcaaaactgagccaattaaacttcttttttttttataagttgtaagttttttttataagttatttcttatagcagtgtaagaattaactaatacaagtgattacaaaattgatttgaagtaaaggtttcaaattatttatgtggcattgttatacagtggcaagacaaagaaatgtgggagtagctttgcctggggttgtgccttgcctctgctatacatttgggggagaccatgggcaattactgcattgcccagagcctcagttattgaatatgaagaaaggaaattaagagtagcatctgccccatctacttcaccaaatagctggtaagatcaaatggagcaatatcacatataaaagcaaccagtaattattattactgattaaatggtgtcatattccttttattaacttttaaatatgttttcacttctatgtgcacccaatttgttttctgcaattcaaagacacactaaagcaaaaagactgtcattctatctctttgtaatttggctgccttttcaagggttatctagttaatttgtgaactataaatcctgattagattagcacttttacagtttaatacattacttaatggtcaacctatgaacagagactccagttactcagaaagccactgcctcactgttttatttcactgacagtatggcctattgtctagtatctggtgcatttttattatttcttatgtaagaaaaagtgctttcatctcttttacttgggtcagttaattatctgtgaagtcatacaaacacaagattgttgtgggaacttaaagaccatgaagattcttaaaccacaaatcagattgagtttgaaacaaataaatcatttttaactattgaagaagtaaatgctttaaagtgcattattactaatactttttcacaatgtgtatttcctaaatttcttcaggctacagcaacatccaaaaactgacaaagtgtctttataagtaagttataccaatatgttaagctcatcaaggaagtagttataatgttatttatataaagctatttgtggaaggaatagtaagtggcatgaactacagctaactataatcctcaaagcaatacagatgataattagttctagaatggaaacagcttttagagtttattaaaaattgggtttaccaagaacatcttactgtatgtaggaagtgatacggaagtacggcagggaagtgctggatagagaaaggcaggtccctggctaaggctccacaccacagaccgaggtgaggacaggcactcctgcttttgtgcacaaatgttgcatttcccaagaccaccctggcccaccacatccccatcctgggcctataaaaacctgagacactagcaggcagacacacaggtggccagatgttgagagcagcacatcagctgaagaagacacaagtggttggacggcaagaggacgtcaagcgatcatgctggcaaaagagtacactgacagactctggcacactggcagcccatcaaccagcgggttgagatggagtttggctagggcagtcggaggagagctggggccaccaagcagcctaactctaggggaaaaccatctcccttctcgcttccccatcagcggagagctacttccactcaataaaactttgcactcattctcaaagaccacgtgtgatccaattcttctgggacaccaaggcaagaacccaggatacagaaagtcctctgtccttgtgacaagctagagggtctaattgagctggttaacacaagccacctacagagggcaaactaaaagatcaccctgtaacacatgcccaccggggtttccagagctgtaaacattcacccctagacactgtcgttaagtgtctatctgtatgatccccgagaggttagagcagtggggcactgaagaagcaagccacaccctcattgcatgccctgcaagggggactagggaacctttcccatttcaaatgggagctctgccaggatcctggaagatgagtgtgaatgaatgtgaaactgtcatgtctgcctctcttccaaaacctcccacttctctcttttctgcgggtaagaagctctgtttcccttcaaaactctgcccttaccagccagtcaaaattcccagacttcgtatcttttctctcatatggtttgaaatggcttttatctctttctttataatgttaagagttttgctacaggctatggcaatgttactaagtaaaacgagcattaggttcagccatcaaaggtgcaaatcagatcaatttttcctagaggtgccatgtatgcctccaccttaacagccacagacacacacagctcagggcacctcttcttaccctttcccctcccagcttgggtccctaggcatgccagcagcaggcaaaggccaagcccaacagccacgagtgggtatggaacaaagctgcgacggtaaccatgaccccacagggtcaacgaatgggtgcttctcacccaccacgctaatggaacctttctttccctggccaaggaattcagcctagtctgaaatcgggtaaaaatataaggattagagggttccagttgtactaagcaaggggttcttcccccagaatcttcccccttttcctcttaaactgtttttcttttttctttttttttttcctcttctaagtgagaggcgtcccccaccaccaactctgtttctaatagggaagttaacagagtaatggcccctgctgactgataactgcaaattcgacagggcacatttgagacactctaaacagatataaacagcctctaaaataccttttcagtcccaaactggactccaagcttcaggctgaggccctagaaagaaaaacaaggtttgaaggattcaaagccaggcaacaggtataatgtaaatgggcagaaccaattcctaccaactaaaccccccacctcacggaaggaggccatgcttcatggcataaacaggctcaggaaactcaaggtttgctgaaagcagggagaaatgggggcaaaggtgagggtggttaattcctattctccaggttttccctgcttcgtgggtacatactgcatcagtatccatggccggcacctgccaaggtcatcggggctcagggataagcagtggagagtgaaaggaggacattcattttctgagtctttgttgaaagaagaaagggaatgagggacacctctattcactgtctttcagaatgggcaaccagttattttcaccacgctcagcctatactcctctggagtgtattctgaaccactaggactgccttgagcctcagaatctggaggaaaagtgcctcttagccctctgcaaaaaggtttggccaaattatgatttacaggaaagagtggcttggcctcaggaaggaaccattcatttctataccatctggcatttggaacttttctatagacgtgaggacagatggcctgaggccccataagtgtaggctttctatagcttgcaaggcaatccagacctttgctgacagagtaggattgccctcctgtttggcatctcagggaaggttgcaaggggcaagctcaagcaactaaaaatatgagtcccaggggcaaccccagcagaggatccagctacctctgaccctgttactcggggtccacccagaccaccctatacagcttcagcttcccacctgcctcctcctaaaaatctttgctctagacaaactccagtctcactcttaaccctccaacaaatgcccagtaaatttgggcctagtaaggtccaggtccccttctccgtataggacttaaagcaaattaagggggatcttggcaagttttcagatgaccctgatagataaatagaggctttccagaattatacccaaatatttgaactctcctggagagacgttatgttacttttgaatcaaaccccaatggacactcagaagcaggctgctctgtcagcagcggagagatttggggataagctttctttcatatatagcgtcagagaaggggatgaatattatccaactggaagagaagcaataccagtaaataatcctaaatgggatcccagtgacgagatggaagactggaaaagaagacactttcaggtgtgcataatggagggcttacgtaggactaagactaagcctctcaattatattaagttgtccatgatcgactaaggatttgatgaaaatcccactgccttcctggaaaggctaagagcggccttgacaaagcacacctctatctcctgattcagtcgagaacagctaatcctaaaagataaatgtattacccaggtagctcctgacatcaggaggaagttgcaaaaatgggccctgggaccagatagtacattagaggacctcctgaaagtggccaacttggtcttttataatagagacaggaggcctaaaaaagcgagaggagatgcaggaaacagacaaaagctttgatgaccaccatgtaagcccacaaaccccaaaattcccaggatgtgcctgctaactgctaaaagatacggcaagaacagttatttctcttccaaagtttaactgctcccataaaacgtttaatttctttcaccagggtgaaacagctcagggtagaatgttgctgttagtatatttcacttcttatctctgtaatctctggcactaaattctttccttgtataatacacatgtttcacccatgcatacttaaccttataaaacttttttttttttttactctcaagcctagaagccatcaaaatccaaatggtcaaccggagcctcgaaagatggctccccttgtctaggaacccttagaccgctaggagtctgactgccatttaccccagaacaatgccccctgtcagcaggaagcagcaaagacaggtcacagtccatattctaaaggtagttagatgtacatcttcagaggggagaatgataccggaggggtcgaggaagtgctgagtagagaaaggcaggtccctggctagggctccactcccttggacctaggtgacaacaggcactcctgctttcatgcccaaatgttgcattttccaagaccactctggcccaccatgctctcattctgggcctataaaaacccgagacccgagtggaaaaacacacaggtagccagatgtcaagagcagtacatcagcggaaaaagacacaagtagctggatagcgagaggacgttgaggcagcacactggcagaagagcacaccgacagaaaccagcacaccagcagaccactgaccagcaggccactgaccagcaggatggggtggagtttggccagagcagttggaggagagctggggctgctgagtggcccaactccagggaaataccatctcccttctggctcccccagtggtggtgagctacttctactcaataaaactttgcactcattctccaagaccacgtgtgatccgattcttctggtaccccaaggcaagaacctgggatacagaaagccctccatccttgtgacaaggtagagggtctaactgagctggttaacacaagccacctatagatggcaaactaaaacggcatcctgtaacacacacccactggggccttagcatctgtaaacattcacccctagacactctcgtggagttggagccccacagtcagcctgtctgtatgctccctagaggtttgagcagtggggtactgaagaagtgagccacacccccatcgcacgccctgtgagggggacgggggatcctttccggtatcaaaagcactacctattggtttcttatataacttaacagttttttgaggacttactatgtgctaggcactgttaattgtgtgtgtggagagagagataagttttcataaatataatatctcatatatataattttaattaatgatcaaataattttattagataggttctattattatgctcatctttcaatatggaatctgatgcaatgacagattagggaagtaatttgcccaatattatgaagctagtaagtggtggtttcgtttcaaaccacacgccctgacaggggaacctggttatcaaccaatctgctttctgtctcttgtctctcgattcatcatgatgttgtgcctgcaacacacacacacacacacacacacacacacacacatctgtccatgctaggtacttctagaatggcactctgatatcagccacagcaatcagaatccaaggagaaactgtttccttaaacacctctgcccttctcaggtacttctagaatggcagtctgatatcagccacagcaatttgaatcaaaggagaaactgtttacctaatgtagttattttctgtcttattctcccagctccttaacatggttgtttttcatagaacttagaaagaagaagtggatgcatcctagaaatagcagaaaacaagtcagagaggttgctgtacacaataatgcagctttcacagagatttgaacatatttacatttatataagcatccagtggtgtggaggtgtatgtctgagagcaaacctcatgaagtttttccagactgcaccctgagtagtgaaaggtgaatggaattgttctgctcattgacgcaaaacagggtaaaaaggccttgtgcagagtcagtgacttttctacaatgaagccttatgtcactgtagcacttgtcacctcactgactgttgggttgattagcctgatatgtcatcttcttcctttctcagagtgaccgtattcatgaacagtgcactcatacaaagccaatcttcccaacagaaaaaaaaaaaaaaatccatgtctgcgttaagtgtgaaagtggttgccttctgctgttggacatcagcaaagccctggcagttcacaggctaccaagtgtgtgcttgcttttgtatataaaaagttatgtgttctagtgaaaatactgatgttagtgtatgagaaaataagtgacacaggaaaaaactgaagcacataggaacaaagataatttttaaaaatggaaaagctggaatggctgaaaaaaagactagcgtttgtacactattgcattcaatttgtaaataataaaatgtatcaatttttaaaattacaaagctctttttaaaattaaaaactgtatgtttgtccttttagatccagttcagacttcacatactttatttcagaattggcctgtaatgtaacaattatctctaggaagatttatgtttgatttttaataattcaagcaaggtaaatgaatgatgggtaaatatggattattgactttttcctctaacccctattaaataaatagaaaaagcagaataataaaaataaaatcataaaaggagctaaacaaagggatacaattgacataataactttgagaagagtcaaccaaataaaatttattgaggtgtggctgggtgttattccaatacacagtgtgtgcccaacacacagacaccaaatgaagaataggaaagagacagtcataaaaagaacaggctagtctcaccaataccacgtcaatagggagaaaagtaggtgaaaagaagtaaggaggagacatctgaaatccttattaaagctggctaatcatctatctgaaaaatcttaacagagacaagaaaattgcaaatctgaaggtttccccacagagacagcacacaggaaaacaggtcaatagaaatctggcatttaataaaatccagaaaaagacaagaaagcccagatctttcaacagagaaagctgagctccccagtcctatcctcctccccatgccttggagctagcaggatacagaagagtacaatacagaacccgcaaacagtagctccccagaaaagactgagagagctcagtaagagtgaagagaatttcaggaagaatttagtttcactatatcagaaaagatggaaggtaggaacaaagccactcacaataagcataggcaagtgaaatccaaagaaatgacacaactagatatataaacaaactagtatctttagcatgtaacgggtgaaaaaaataaaaaacataaaatttggtagaaaacatagatcaggaccataagattttccacaagtcctttggctacaaaagaagtaatgaaagcaaactttttgaaaagagcaaaattaacctcaaagatggagcaacaacatgacaggcatcaaaggaaaactaattaaatggtcacctgctcctggattggatcctataccagaaaaaaacaagctgtaacaaacatcaatggggtagttttaaaaaactaaatatgccatgtggattagaaaatcacattgtatcttgtaatgtgagcttcctgattttgatcattgtgctatggttatataagagaaagcagtttttctgggacacacacactgacatatttttttgtaaagtgttacaatgtttttaacttcctctcactgttcagaacaaaaggaggtacaaaaggagggtgtgtatgtgcatgtgtgtgcacacgtgtgtgtatgcaaataggacaaaacatagctagtgaaccgggtacagtgtatgtgggggaagagttctttgtactatacttgtattttgcaaattttctgttttaacttatatcaaaatagaaaactaccaaaaaatgtcaaagaaaaagttacaacatctttagagaatgacttttttaaaagtcaagtgataaagagtacactataactaggtaaaaattaaaatcctgacatatagacaagcttgagataatgatagcaaatacaaagggaaattaaaaactagctaaaacaattgaagaaatataagtaatacttttttaaagagacgccaacataaagaaaataggtttctcagcaggagaaagcctaatggaacagaaaagcaattcaaagatataaaaacagaaaatttctttgaaaataacgggtaatgtactctacagacagagagagaaccctgtgtttaaaaaaaatgctgaattattgacactaaaacaaaatcctggaccagttactgactttcaaggattaagaaaaatttctccaagcattcagtcaggaaagaagcctgtcacatgtgtgtgtgtgtgtgagagagagagagaatgagagagagagagagaaagggagagagagagacagagaatctaggaggcttcagattacttcacagcattcggagccagaaaatggcaaatcattatatacaaggtttaagacaaaggtgaccaaatgatattatcctcggccaatttgccatctaaatagaaatgtagcaggtattctcaaatataaagaaaactcaggtaataaaacttctataaattctacctgcagggaaaaattatatgataattaaactgaaccaaacaaaagtttaatgaaaaaagctgtgataaagggctaactagcaccatattcagggtcagacgacaacaggaaaatgtctgctacatacagaggaaaggaaactgtgacctactaaatacatctaatgtgccattcggcaataagacaaaaaacagacattatcatgaatgctataataaaaccatcaagagatgaaatcaagataaaaggctcaggattgggaagtcatagaagaaaatgctggtactaaacatttaatccatattgattttcactaagaaaaaaataaaaggaaaactttacaaaacaagaaactataactacaacaagggatgtattcagtatgatctagattagcatgtggttttaaaaaataaacaaatgagccctcatcttttattatagggaattattactatctgaaactaaagcatatagttagaaatggcctccattactctttatttttaccttttctctcaatttttaaatttatttttaatttttgtgagtacaaagtaggtatatatatttatggggtacatgagatattttgatacaggcatgcaatgtgtgataactaaatcatgaaaaatttggaacacatctccccaggcattacgcttttgtgtttcaaacaatccaattatattctctagttatttttaaatgtacaattaaattataattgactatagtctctgggttgttctatctgacactaagtcttattcattctttctattttcagtacccattaaccattcccaccactccacccacactccccactatacttcctagcctctggtaagcattcttctattttctatctccatgagtttaattgttttgatgtttagatcccacaaataagtgataacatgcaaagttcgtcttgctgtgcctggcttatttcacttgacaaaacaatctccagtgccatccatgttgtcacaaatgacagaatcttatcctcttttatgattgaataatacttcattatgtatatgtaccacattttctttatccattcatctgttaatgaatacttaggttacatccaaatcttggccattgtgaacagtgctgtaacaaacataagagggcagatatctcttggatatatgggtttctttttttactttttaaattgttgtgggcacatagtaggtgtatatatttatggggtacatgaaatgttttgatatagacatgcaatgtgaaataagcacatcatggagaatggagtatccatcccttcaagcacttattatttgagttacaaataatccaataacattctttaagttattttaaaatgtacaattaaagttattattgactatagtaaccctgttgtgctatcaaatagcaggtcttatgtattatttctaactattttttggacccattaaccatcccacctccaccccaccccaccccaccccaccccactaccctttcaagcctctggtaattatccttctattttctatctcaatgagttcaattgttttgatttttagatcccacaaataagcaagaacgtgctataattgtctttctgtgcctagcttatttaacttaatgtaatgatctccagctccatccaagttgctgcaaatgactggatctcattctcttttatggctgaatggtactccattgtgtatatgtatcacattttattttccattcatctgttgatggacccttaggttgcttctgaatcttagctattgtaaacagtactgcaacaaacataagaatgcagatatctcttcaatatactgatttcctttcttttgggtatacacccagcagtgggattaatgggtcgtattgtagctctatttttaactttttaaggaacctccaaactgttctccatagtgtttgaactaacttatgttcccaccaacagtgtacaagggttcccttttctccacatgcttgccagcaggctttattgcctgtcttttgtataaaaattttatttgtggctattacaaatggaattagttttttatttctttttcagattgttcactgttggcatatagtaatgctagtgatttttgtatgttgattttgtatcctgcaacttactgaatatgtttatcagttctaatagtattttggtggtcttcaggtttttctaaatttaacatcatttatccacaaacaaggattatttaatttcttcctttccgatttggatgccctttacttctttatcttttttaattgctctaaaacatacagtactatgctgattaacagcatagttatgtttcaggtttaagagggcaaacttttaggttctccctattcagtttaatactagctgtgggtctatcatagatggcttttattatgttaagaccttctatacccagttttttaaaggttttcatcatggagggacgttaactttatcaaatggtttttcagcatcaattgaaatgatcatatggttattgtcctttattctgttgatatgatgtatcacattgattatggccattctttcaggaggtggtatcacattgtggttttgatttgcatttacctgatcattagcgatattgagcattttttcatgtgtttgttggccatttgtgtatcttcttttgagcattgtctattcatgtccttagcacactttttgaagggatttttttctttttttactgatttgtttgagttcattgtacattctgggtattagtcctttgtcacatgtatagattgtgaagattttctcccagtctgtgggatatctgtttgctcttctgactgttccttctgctgagcaaaaactctttagtttaattcggtctcagctatttatctttgtttttattgcatttgcttttgggttcttggtcatgaaatgcttgcctaagccaatgtctagaagggtttttccaatatccccagtgagttttgattatggctataatcataaaacagtagatgttggcatggatgcgttgaacagggaacacttctacactgctggtgggaatgtaaactagtacagccactatggaaaacagtgtgaagattcctttaagaaccaaaagtagaactaccatttgatccagaaatcccactactgggtatcaatcttctagggtttttatagtttcccatcctagatttaagttcttaatccattttgatttgatttttgtataaggtgagaaatgaggatctagttttattctccaacatgtggctagccaattatcccagcaccatttgtttaaaagggtgacagtgatagtttgccttcgtctttactgatttggatgccctttgtttctttctgttgtcttattactctggctaggacttcagtactatgttgaagaagagtggtaagagtagacatcctggtcttgttccacttctcagaggaaatgctttcaacttttccccagatggcttttttacattaaggtatgtcccttgtttgctgattttgccgagagttttaatcataaagggatgctggattttgttgaatgctttttctgcatctattgaaatgatcaggtgatttttgttttaattctgtgtatgtggtgcatcacatttattgacttgattatggcaaaccatccctccatccctggtataaaatctatttgatcaaggtggattatctttttgatatattgttggatttgattagctagtattttgttgaggattttagcatctatgttcatcaaggatatcagtctgtagttttcttttttggttatgtcctttcctggttttggtattagggtgatgctggcttcatagaatgaactagagagggttgcttctttctctatcttgtggaagagtggcaaaaggattggtaccaattcttcttcaaatgtctggtagaattctgctgtgaatccgtctggtcatggacccttttttttgataatttttaaattaccatttcaatctcactgcttgttattgatctgttcagggtatctaattcttcctgatttaagctaagagggttatatttttccaggaatttatccatgtattctaggttttctagtttatgcgggtaaagctgttcttagcagccttgaatgatcttttgtatttcagtggtgtcagttgtaatatctcctgtttcatttcttagtgaggttatttggattttctctcttcttttcttggttaatgttgttaatggtctatcaattttatttatcttttcgaagaaccacctgtttgtttcatttatcttttgtattttgttcatttgtttcaatttcatttcgttctgctctgatcttggttatttcctttcttctgctgggtttgggtttggtttgttcctgtttccttagttccttgaggtgtgaccttagaatgtcagtttgtgctctttcagtctttttgatataggcgttcagggctatgaactttcctcttagcaccacctttgccttaccccagaggttttgatacgttgtgtcattattgtcattcagtttgaagaatttttaaatttctaccttgatttcatttttaatccagtgctcactcaggagcagttatttaattttcatgtatttgtatggttttgaagattgcttttggagttgatttccagttttattccactgtggtcagagagtgcttgatataatttcaatttttaaaaaatttattgaggctcattttatggcctattttgctttttaacttgtatttttgttttataagtcctgtgtgaattaagctttaaacaggttctgttttgatgtgtttctagggtttgtttcaagatttagagctctttttagcagttcttatagtggtggcttggtaatggtgaattctctcagcatttgtttgtctgaaaaagattgtatctttccttcatatatgatgcttagtttcactggatacaaaattcttgtctggtaattgttttgtttgagaaggctgaagatagggccccaatcccttctagcttatagggtttctgctgagaaatctgctgttaatctgataggttttcctttataggttacctggtgcttctgtcttacagctcttaagattcttccctttgtctcaactttggataacctcatggaaatgtacctaggtgaagatctttttgcagtgaatttcccaggtgttctttctgcttcttgtatttggatgtctaggtctctaggaaggccgggaagttttcctcgattattccccaaacacatttttcaagctcttagaattctcttcttcctcagaacaccaattattcttaggtttagttgtttaacataatctcagacttcttggaggctttgttcatattttcttattctttttgctttgtctttgttggattgggttaatttaaagaccttgtctttgagcttcaaatttcttctacttgttcaactctattgctgagattttccagaggattttgcatttctaaaagtgtgtccaaagttttctgagttttttattgttttgtctttaagctatctacctccttgaatatttctcccttcacttcttgtatcatattttgaatttccttgcattaggcttcgcatttctctggttcctccctgattagcttaataactgatcccctgaattctttttcaggtaaatcagggatttcttcttggcttggatcaattgctggtgagcatgtgtgttttctggggggtgttgaagagccttgttttctcatattaccagggaaggttttctggttccttctcatttgggtaggctctgtcagagggaaggtctagggctaaagcctgttgttcagattcttttgtcccacagggtgttcccttgatgtagtactctccccctattcctatggatgtggattcctctgagctgaactgcagtgattgttgtctctcttccgggtctagccacccagagagtctacctggctctggactggtactgggtgttgcctgcccagcatcctatgatgtgaaccatctatgggtctctcagccatggataccagcacctgttccagtggaggtggcggaggggtgcaatggactctgtgaggttcttagctttggtggtttaatgctctatttttgtactggttggcctcctgccaggaggtggtgctttccagagatcatcaggtgtggtagtatgggggaggaactggcggtggtcggggccctagaacacccaagattatatgccatttgtcttccactactagggtgggtaggaaaggaccatcaggtgggggtggggctaggcgtgtctgagctcagactgtccttgggcaggtcttgctgcagctgctgtggggaatgggagtgagggtctgagttcactggagttgtgtacctagaaggattatggctgcctctgctgagtcatgcaggttgtcagggaagtgggagaaagccagcagtcacaagcctcatccagctcccacacaaactgaagggcctgtctcactcccaccatgccccaccacccaacagccctcacacccagatcatttccaggtgtggagctatatgggtttgaaaacttgtcccaggctacccgcctcccaactgcaaaaaaaaaaaaaaaaaaaaaaaagtgggggcgggggcttggttcttcccctacctgtggagtctgcacaccagatttgcaccctcccccaaattctggacagaaggcttcccaccccaatcaaatggttacaaagttcagctagagatttgcttatcactgtgtagttttaccccttgctcttttggatccctgtggtgcaggcaggaatggcctggtaggtgacccaacaagctcccagggcctttctgcttcttcctctacccctgtattttgctcggctctccaaattaactcagctccaggtaaagtcggaaacttctcacgcaaacagaacttcagctttcagcttctccagtggggatgtatgtttggaagagggggtctctctttcccacttcaacagttggggcactcagtttttgtgggtcggggggggcgtctcccaggtcctgcaggagcagtctgctttcttcagagggtctgtgggtcctctcaggatttctggtttgctcttgcagtccatctggaactaaaattcacaatgcgagccagccactgcctgttgctctttctggagctgcaatctagtcctgcctccagtctgccataatctcccgcattctctaaccgtttttgttggaacactttcaataggattggtataagttcttctttaaatgtttagtagaattcatcagtgaaaccatcaggttctgggcttctttatattgggagacatttttggtttgtttgtttgttttgagatggggtttcactcttgttgcccaggctggagtggaaaggtacagtttcagctcactgcaacctctccctaggagacatttttattatggcttcaatctcattgttattggtatgttcaggttttggacttcttcgtggttcaatcttggcaggttgtatatgcctaggcatttatccatttcttctagattttccagtttattgttatataattgccatagtagccactaatgatcctctgaatttctgaagtatcagttgtaatgtcttctttttcatcactgattttatctatttggctcttctctcatttttccttaatctggttaaaggtttgtcaattttctttatcttttcaagaaaccaactttttgtttcattgatcttttgtgttgttttcttccattcaaattcatttatttctgttctgatcattagtatttcttttcttccactaatttgaggtttggtttgtgcttgcttttctagttcttttttttttttttttttttgagatggagtctagttctgttgcccaggcttgagtgcagtgatgtaatctcagctcactgcaaccttcacctcctggctcaagcaattctcctgcctcagcctcccaagtacctgggattacaggcacgcaccactgcgcccaactaatttttgtacttttagtagagacggggtttcacctgcctcagcctcccaaagtgctgggattacaggcatgagctatggtgcctgtcctctggttctttaagatacaggttttatttatttgaagttattttgtttttgtttttatttcatgtaggcacatattgctacaatttctctcctactgctttcattgtatcctataggttttggtatatggtatttacattatcatttgtttcaagaaatttttccatttccttcttaatttatacattgatacactggtcatttgggagcatactgtttaatttacatgtgttttccaaaatttctcttgttactgatttatagttttatttcactgtggtcagagaatattcttgacattatttccaatttttggatattttatgacttgttttgttacctaacacatggtctatctttgagaataatccatgtgcagaggagaagaatatgtattctgcagctgttggatgaaatgttctgtaaatatctattaggtccagttgttctatagtgcatattaagtctagtgtttcttcattgattttctgtcttcaagatctgcccaatgcagaaagtggagtgttgaagtctccagctattattgtattgaggtctatctctctctttagttctaataatatttgcgttatatatctgggtactccagtgttggtatgtatatatttgtcaccattataccctcttgctgaattgacccctttatcattatataatgaccttcttcttacagtttttgtcttgaaatctattgtgtctgataaagtatagctactcctgctcttttttggtttccattgtcatagaatatcttttttccattcctttattttcagttcatgtgtatctttcaggtaaagtaagtttcttataggcaacacatcattgggctttatttttccatccattcagccattctgtcttttaattggagagtttagttcatttacattcaatgttgttattgataaggacttactcctgccatttcattatttgttttctggttgttttgtagtcttctcttctgtctttccttccttcctctcttccttttagtgaaggtgattttctctgctggtatgctttaatttacgctttttatttttttatatcttttgtatgtttttcaatttgatgttcccatgagacttgcaagtaatatgttataacccatcattttaaactgatggcaacttaacactgattacataaacaaagaaatgcacaacatgaaaactaataaaaactctatactttaaactatgaacctgctttttaactttttgttgtttctctttatgtcttactgtactgtctgtgtcttgaaaagttgttatagttactatttttggttgattcatcatttagtctttctacttaagtcaggaaaagtttacacaccaccattacagtgttatactattctgtgcttttttctgtgtttataccagtgagctttatactttcacagtcaacaatctcagcagtttacctgaggttctattctactgcagctaagttggcactcagaccacaagacaaagtccttcccactcttctcttccctttctataggcagaggtctctgtggccttgaccacccctagtccatggggatttctactcggccaccaccaatgtttgcctaaagcccacgggctcttccatcggcttatgatgaatgctgtcaggcctgggactcacccttcaggatactgggctcccatctggcccatgccaggccaagtctagaaatactgttcaagaatctaggtctggacttcaggtccccacgaacctgcttgttgctctattccactgtggccaagctggtagccagggtacaagacaaagtcccctttacttttccctctgctttgcaaaatgcaatttttcatcattttcattgtagttgccacagctgagaatgtgctgggtctcccctgaagccagcacatcttagagtccaaggcctgtggtgtactcccttggtatcactggagattattcagggtctgagggctcttcagttagcaggtgatgaatcctgccaggactgggttctcgtcccttcaaggcagcagattcacttttggctcaggttgtgtcaagaaatatcatctaggagctaggacctgaaatggggggctcacaactctgttcagtgccctctcctactgtggctgagctggtagccaagaagcaagacaaagccctccttactcttcactctctttcattatgcagaaggaaggagtcacttttgttgctatgagctgcatagcctggggttgggggagggatggtgcaagctctcccttagctgtgccaggtggtgtctctctaggtcatgtgccatgcttgttcactgactctaagcccagcctagcactagctgctgcctacaaattgtagtccttgtgtcctagattgcctttcaagtttacctatgacccccaggcacttcagctcaatgtggcatggcttcccaaggaagtcaagttctgaccgctggaatggatgattcccctctggaatgtggctggtccaaatgcttcctccatgcatgggcactggctgagcccagcacagctttattctctgctgtgaccaggtagcactgagttgaatgtgaagtcctctagttgatgtgctctccctccccagagagcacagattctctctccacactccagggttgctgccaggaggtgggggaagggtggcattggtaattcagtatgtctctcttgcccttttcaatacctctttccacaacatgaagttaaaaccaggtactgtgattactcacctgagttttggttcctgccacggtgctttcctatgtgtagacagttgttaaaatttggtgttccagtgtcggggaggatgggtaaatgaatgatgtaggcttctgttttgccatgtttctcctccccttttttctcaacttttgaaggtatatttgtaaaaataatggattaaaccatataaagttgccaatattctactttttttggtctacaaaagggtaatttcgtacagtttgtaagatacaatgaatctttgtgagtctctcttcaaaaggtttagcctgttaacttccttaccctttgttctccaacttaactttcttgtttctccttgccaaaagttactataaacagcttacccccttcccgtcagttctaatcaataactcacatctcttcccttggttacctgtacccatttttcccttgaaactgcacgtctcacaagctccaccactgtacctcacatccccctcccttccatatttagaaaaatatttacaagtagccaattgggtcagctcagattttgcggtccaaccccagcccacgggggaagaacacagaaatagggatgacgttaagggtataaaaaactcccggtcccctttgttcagtgtgcacttgcaatcttgattgacgtgagtggcacccttttgcaaaagtaaattgccttgctgaggaaactaaatttatattcgagtgctgtttcttttgaggcatcggaaattcatttataacaatttggtggctcgtatggggagcccattcttctctggggagggatttccggtcctttcccgtgagaaggcacgccccgccacctcattgcagtggcttcaggttgaggaatcgagacccacccagtgtgatgaataaacccggcctctcagcaacccgggaaaggaacaagccggcagcttgggaaaatggggctcacatactgcagcgaccaggtaaactctgtgcacaaaccaaggtaagaaaagtcacaggggcgacaaagtatttccttggaagttgaaagtgtgtgaatggtaacaattaccactgctgtgcagagtaagtccaatctgcggttccacggtcacctcatatggcttagggtggccctttgggggtcccgtcaggggtttatactggcccaccatccatgataagagggacctgaaatatttctgcaagggaagcatccagagtggacgaagctaaagaagggtacaaggaaccttcagcaggtagggctaaaggataggcaagagattcctcatacaagggaattgagcgttaataagcctccagggaaggataggcaagaaatttctaatatgagaaattgagcctaactaggacccaacatgggaaataccccaagtattatgagaagtgaaaaggataaagatagcaataaatatattcccccagatagtcccctaggtctcatgttaaaatattggaaaggtattgagagaactaaacataagaaaaagcaacaaatgataaaatattgctgttttgtttggacccagggtccactcctcaagccctcaatcttctggccagtttgggtcaaatgaggatgtaatgtatcaactcctaattcaacatgtaaatgataaaagttcagtgttctcaagagaaactggactatgctctttgttagagacagggacctgttctcctctatcccttaaaaacaactagggaaaagcccgatctagcatccgacaatgaagactcaaaaaacctggtttccatggctaaggactccagcgcatgggatcccctagaccaccttcccccactcattgcccccaatccttcccctcaggcagctgctgctgccctggatcctgccccagatccttcttctccttacgttattcctcctccttataatcctgattcttgggaatcatcatgccataaacctgttccctctcagcctaagtgcccctccctgaaggaactccaacatgaagtagaacaatgtaaaagagatatccaaaatttctcatttccctccacatctatggagtcagctctgactctcttccgcttgagagaggtaccacaaggaggaggtgctattggctttgtaagtgctcccctaactagttcacaagtctggaatttaaagaaggaacttaagccattattagatgacccttatgggttagcagatcaagttgatcaatccctgggacctcagttacacacctgggttgagttaatgtccattttaggcattctcttctcgggggaagaaagagggatgatcagtagggctgctatggtaatttgggagcgtgaacaccctcccagtcaagacgttcctaccgcagatcaaaagcttcctggccaagacccctggtgggacaataataacccagctcacttggaaaatatacaagacctaagggagatgataataaagagaattagggaatcagtaccctgaacccacaacctctctaaagcacttgatatacaacaggaaaaagatgaggggcctatgaaatttctaaacagattgaaggaccaaacgagacaatattcaggcctaaacttagaagacccccttggacaaggaatgttaaaactccactttgtcactaagagttggccagatatttcaaagaagatacaaaaattagaaaattgggaagaccgacctctgagtgaacttctcagagaagatcaataagtatatgttagaagagatgaagagaaacaaaaacaaagggcaaaacttggtggaaccaaatccacatacttctaaacaaagcttccagggggccggaaactataccaggtccagacccccgtttaaaagaaccaagcctccatctagaggacccagaccctcatctaccagaccctctaaagagtatgggggaacaacgttgcaaagtcctggagctgggagagaagaaggacaagagaggtgttacagatgtggaagggcaggccacttcaaaagagaatgtcccaaattacaaagggagagacaagccctttccctcattacctctgaggaggagtagggggctcaggggctctgtctcttttacttcaagtcccaccagaagcccttgatacatttagaagtgggacccaatcatgagcttatcacctttctagtcgattcaggggccgctcgctcctctgtttccctctatctgacattgcctgctcttcagaagacctttgagtctctgggataaaagtggaagggtttaaagcaaaagtcttagaaagtacagaagttaaattctaagattgattgactcatatccaatttttattgatccctgaggcaggaactaacttattaggaagagaattaatgttgaagttaggcatagtcttataagttagtctaaaaggattccttgcctcattaaatttactcaccaccacagatgagaaatgtattcactcgttgtgaaggaaaccaaggaaaacttcagattcccacaatccacatcaagctaaaaaccccagaggaagtggtgaggaggaagtaattctctattccttcagaaggacagatagggttaaagcccataattgaaagtgtcatgaaagatgggcttcttgagccttgtatgtctctttataacaccccaatactgcccgtcaagaaatcagatgggtcataccggttagtacaaaatcttagagctatcaaccaaatagtaccaactattcaccctgttgtccctaacccttacactattctcagtaaaattccatatatccatcaatggattactgtaacagactcaaagcatgctttctgggcatgtcccctagctgaagatagctgaggcacattcacttttaagtgggaagacacccagtcagggtaaaaacaacagtatcagcagacagttttgccccaagggtttgcagactcacccaacctctttagtcagattttagaacaagtgctaggaaaggtttctgttccaaagcatacatgcatgctccaatatgttgatgatatcctcatatcaggagaggatgtggaaaaagtaaccagtttttccatacatatccttgatcatctacattctgaggggctacaagtctcaaagaaaaagcttcagtatgcagaacctgaggtcaaatatttaggccatttcgtaagtgcaggcaagtggagaatagtgccggagcaagttgaaggcatcgtgtatttacccttgcctcaaactaagcatgagctcagaaaatttctaggattagttggatactgccgcttatggattgactcatatgccttacacagtaagctgctataccagaagcctactccagaaaaacctgaccatctcctgtggacttctgaggaagtcaaccaaattgaggaattaaaagaaaggcttatgactgccctagttttagcttcgccttctctagaaaagccctttcacctttttgtcagtgtaaataatggagtggctataggagtgcttacccaagagcacagtggctgccggcagcctgtagccttcttatcaaaggttttagacccagtcacttgtggatggcctcaatgcatccactctgttgctgctatggcaatattagttgaagaaagcagaaagttaactttaggggtaaagttgactgcaagcacaccccacgaagttagagcaatactaaatcaaaaagctgggaggtggcttactgactccagaatcctgaaatatgaagttattttgctggaaaaagatgatttaaccttaactactgataattcactcaacccagcaggtttcttaacaggagatccaactctaaacagggagcacctatgtctcaatttaattgactaccaaaggtcagaccagacctaggggataccaccttcaaaacaggatgacacttattcatagatggttcctcctgggtgattgagggaaaaagacacaatgggtattcagtaattgatggggaaactcttgaagaaatagagtcaggcaaattgcctaataattggtctgcccaaacttgtgagttgtttgcactcatccaagctttaaagtaattgcaggaaggaaccatccatattgattctaaatatgcctttggggtggcccatacatttggaaaaatttggactaaacaaggtcttattaatagcaaaagccaagaccttgttcacaaggagttaatcacccaagtattagataatcttcagtttcctgaagaaatagctattgttcatgtttccagacaacagaaaagcctttcttttgaaagctagggaaacaacttagcagatcagatagccaagcaggctgccgtttcatctggaacacctgtctttcacttaaccccttgtcttcctctactgcagtccctgtcttctcagccgtggaaaaagaaaaattaataaaaataggggccaaagaaaactcagaaggaaaatgggtattaccagaccaaagggaaatgctatccaaacctctcctgagagaaatcctgcctcacttgcatcaagggacccactggggacccaaagccatgtgtgacgtagttctcagagttcatgggtgtataggaatttataccttggccaaacaagtcatggacagttgcttaatatgtaaaaaaaacccaacaaacaagttataaagaaatctcccttggtggggaggaatccagggctaagaccattccaaagtattcagagtgactacacggaaatgcccccagttgctcatctaaagtatttgttattaatagtagatcacctcactcactggatcgaagctattcccttttcaaatgcaacggccaataatgtagtaaaagcactaattgaaaatacagtgcctagattgggactaacagagaacactgactcagacaatggaacccatttcacagcacacatcattaaaaagttgtcccaagacctagacattaaatgggaatatcatacaccttggcatccatcttcatcagggagagtagaaaggatgaatcaaactttaaaaaatcacttaaccaaattagttctagagactcagttaccatggaccaaatgtcttcctatttattgccctgttaagaatccaaactgcacctcagaaggatataggcctttctccttatgaaatgccctatggactgccctatttacactccactacctatatccctacgtttgagacaaaagatcaattcctcaggaattacatatttggtctctcctttaccttctcttctcttaaagccaaaggtctcatggtacaggcaccactcctagagttcctggtccattagcatcagcccagggatcatatcctcatcaaaagctggaaagaatgcaaacttgagccagcctgggaaggaccctatctagtgctcctgaccactgaactgcagtccggacagcagagacttgacacttgagtcaagaaagcaccgtccaccccgaagtcatgggccattattccaggggaaaaccccctcaaactaaagctaagaaaaatttaactctcttccattcttcttttcaccttccaatgctgaccaccttgttattaattaactaaatcaaacacaccccaagttattacatttgacgcttgtctagtcataccctgtagagatctccaaagtcagaggcaactctcagcctcagaaaagtatctctgcccctttaaagtgaaaggcgccccctaccaagactcttgttccttaacaaatgtaggaaaacaagtctgtcatagctggaatgatgtcctgtggaaaaccgaatatcaaggctggacctcatcagcgagtggttgtatatccttaaaaccatatattcgttttactaaggagagcacctcccccagttgccagtgtaaccaatgtaatcccatatacatttctattctcattcccacctctactgatcctaaacctactttaagtcgcttctataacataggagccaacttggctgcacagacctcatagggtcttttgaaatgcgttttattaatccttcattctcttcacccccttccttctcttctccttctgagctttcttctaatcagactgccatctcttctatacctaatgataatactaaagtagatattgtagcagtagatggtctaaggcaaactttagaaattgaaacaggatatcaagatgtaaacgcctggttggaatggatcaaatattctgtctcacattaaataaaagcaattgttatgctcgtgcacatggctggccagaggcccagatcatcccctttccactcagatggtctcccagtcaactgggcatgggctgcatggtagctcttttctaagattccatggcttggggcaacaaattgtggcaagctctctctctgctatatcccaaagtgcaacaccctgtgggtcagcccccaagggccattcagcttcggtcttctgctcatttcacctcgtgtctctcatgacagggggagaacttagtgttccttggcagcttagcaggacgcagtgagcttaagcctttgcaggagcttacccatcagtcgccccttagtcatcctcaagcagatgtatggtggtgttatggtggacccttactggacactctgccaggtaactggagcggtacttgtgctcttgtccaattggctatccctttcaccctggcagttcatcaaccagaaaaagaaaaaacacaacgccacaaaataaaagaagccccttatgggtcttttgactctgacgtttatttagatgcaattggagtcccacagggggtacctgatagattcaaagcctgagatcaaatagctgcaggatttgaatcattatttccatgggtaactattaataaaaatgtagattggataaattatatctactataatcagcaatgatttattaattacactagaaatgctgtcaaaggaatagttgagcaattaggacctactagccaaatggcttgggaaaacagaatggccctagacatgacgttagctgaaaaaggtggagtttgtattatgatcaaaacccaatgttgtacctttatcccaaacaatactgcccccgacagaagcataacaaaggccttacagagactgactgctttgtccaatgaactagctaaaaattctggaattgatagccctctttcaggatggctagaaagatgatttggtaaatggaaaggagtcatggccccaatcttcacttctcttgcagtcatgataggtgtgcttattcttgttaggtgttgcatcataccatgcatccgtgggctagtacaaaagcttataaagacaacactcactaaaacctcccttagttctcctccaccctattcagataagcttttccttttagaagaccaagttgaacagcaaagccagaacatgttaaaaaggtctgaagagaaaagattataaaaatttaaaagggaggaattgtaagatacaatgaatctttctgagtttcttttcaaaaggtttagcctgttaacttccttaccctttgttctccaacttaactttcttgtttctccttgccaacagttactgtaaacagcctacccccttcccgtcagttctaatcaataactcacatctgttcccttggttacctgtacccatcgttcccttgaaactgcacgtctcacaagctccaccactgtacctcacgtccccctcctttccatatttagaaaaatatttacaagtagccaatcagatgagctcagattttgcagtctgaccccagcccatgggggaaggacacagagatagggatcgcgttaaggatataaaaaccccctggtgtcctttgttcagtgtgcacttgtgaccttgtttgacacaagtggcacccttttgcaaaagaaaattgccttgatgaggaaactaaatttatattcgagtgctgtttcttttgcggcatcggaaattcatttataataagttcaacttaatatttttgtggtggaaaaacatttatctgaaatgtacaattaattttaatttgattttgattttccttttattaagttggctaaatatatacttaaaatatatattatggagtgcataaacctatttttgtacaatttttatcatgttccttcaatctgttcattctactaaatatatattcttctatgtttacttatgatataaacagtgatgtttaaaatgattctcacttgggaggagccaagatggccgaataggaacagctccggtctacagctcccagcgtgagcgacgcagaagacgggtgatttctgcatttccatctgaggtaccgggttcatctcactagggagtgccagacagtgggcgcaggtcagtgggtgcgcgcactgtgcgcgagccgaagcagggcgaggcattgcctcactcgggaagcacaaggggtcagggagttccctttcctagtcaaagaaaggggtgacagacagcacctggaaaatgggtcactcccacccgaatactgcgcttttccaacgggcttaaaaaacggcgcaccaggagattatatcccgcacatggctcggagggtcctacacccacagaatctcgctgattgctagcacagcagtctgagatcaaactgcaaggtggcagcgaggctgggggaggggtgcccgccattgcccaggcttgcttaggtaaacaaagcagcccagaagctcgaactgggtggagcccaccacagctcaagaaggcctgcctgcctctgtaggctccacctctgggggcagggcacagacaaacaaaaagacagcagtaacctctgcagacttaaatgtccctgtctggcagctttgaagagagcagtggttctcccagcacacagctggagatctgagaacgggcagactgcctcctcaagtgggtccctgacccctgacccccaagcagcctaactgggaggcaccccccagcaggggcagactgacacctcacacggccgggtactccaacagacctgcagctgagggtcctgtctgttacaaggaaaactaacaaacagaaaggacatccacaccaaaaacccatctgtacatcaccatcatcaaacagagcagaaaaattggaaactctaaaaagcagagtgcctctcctcctccaaaggaatgcagttcctcaccagcaacggaacaaagctggatggagaatgactttgacgagctgagagaagaaggcttcagacaatcaaattactccgcgctacgggagaacattcaaaccaaaggcaaagaagttgaaaactttgaaaaaaatttagaagaatgtataactagaataaccaatacagagaagtgcttaaaggagctgatggagctgaaaaccaaggctcgaagagaactatgtgaagaatgcagaagcctcaggagccgatgcaatcaactggaagaaagggtatcagtgatggaagatgaaatgaataaaatgaagtgagaagggaagtttagagaaaaaagaataaaaagaaacgagcaaagcctccaagaaatatgggactatgtgaaaagaccaaatctacgtctgactggtgtacctgaaagtgacggggagaacggaaccaagttggaaaacaccctgcaggatattatccaggagaacttccccaacctagcaaggcaggccaacattcagattcaggaaatatagagaacgccacaaagatattcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggtagaaactctacaagccagaagagagtgggggccaatattcaacattcttaaagaaaagaattttcaacccagaatttcatatccagccaaactaagcttcataagtgaaggagaaataaaacactttacagaaaagcaaatgttgagaaattttatcaccaccaggcctgccctaaaagagctcctgaaggaagcgctaaacatggaaaggaacaaccggtaccagctgctgcaaaatcatgctaaaatgtaaagaccatcgagactaggaagaaactgcatcaactaacgagcaaaataaccagccaacatcataatgacaggaacaaattcacacataacaatattaactttaaatgtaaatggactaaatgctccaattaaaagacacacacagactggcaaattggatcaagagtcaaaacccatcagtgtgctgtattcaggaagcccatctcacgtgcagagacacacataggctcaaaataaaaggatagaggaagatctaccaagcaaatggaaaacaaaaaaaggcagggattgcaatcctagtctctgataaaacagactttaaaccaacaaagatcaaaagagacaaagaaggccattacataatggtaaagggatcaattcaacaagaagagctaactatcctaaatatatatgcacccaatacaggagcaagcagattcataaagcaagtcctgagtgacctacaaagagacttagactcccacacattaataatgggagactttaacaccccactgtcaacaatagacagatcaacgagacagaaagtcaacaaggatacccaggaattgaactcagctctgcaccaagcagacctaatagacatctacagaactctctaccccaaatcaacagaatatacatttttttcagcaccacaccacatctattccgaaattgaccacatacttggaagtaaagctctcctcagcaaatgtaaaagaacagaaattataacaaactatctctcagaccacagtgcaatgaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacacaacataccagaatctctgggacacatccaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaaatgaaggaaatagagacacaaaaaacccttcaaaaaattaatgaatccaggagctggttttttggaaggatcaacaaaattgataaaccactagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctacaagaaatggataaattcctcgacacatacactctcccaagactaaaccaggaagaagttgaatctctgaatagaccaataacaggatctgaaattgtggcaataatcaatagcttatcaaccaaaaagagtccaggaccagatggattcacagccgaattctaccagaggtacaaggaggaactggtaccattccttctgaaactactccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaacagaatccagcagcacatcaaaaagcttatccaccatgatcaagtgggcttcatccctgggatgcaaggctggttcaatatgtgcaaatcaataaatgtaatccagcatataaacagaaccaaagacaaaaaccacatgattatctcaatagatgcagaaaaagcctttgacaaaatccaacaacccttcatgctaaaaactctcaataaattaggcattgatgggacatatttcaaaataataagagctatctatgacaaacccacagccaatatcatactgaatgggcaaaaactggaagcattccctttgaaaactggcacaagacagggattctgtcaccactcctgttcaacatagtgttggaagtcctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaatgtctcaggatacaaaatcaatgtacaaaaatcacaagcattcttctacaccaataacagacaaacagagagccaaatcatgagtgaactcccattcacaattgcttcaaagagaataaaatacctaggaatcaaacttacaagggatgtgaaggacctcttcaaggagaactacaaaccactgctcaatgaaataaaagaggatacaaacaaatggaagaactttccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccagaaaagagcccgcatcgccaagtcaatcctaagccaaaagaacaaagctggaggcatcatactacctgacttcaaactgtactacaaggctacagtaaccaaaacagcatggtactggtaccaaaacagagatatatatcaatggaacagaacagagccctcagaaataacgccgcatatctacagctatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaactttagaccaaaaaccataaaaaccctagaagaaaacctaggcattaccattgaggacacaggcatgggcaaggacttcatgtctaaaacaccaaaagcaatggcaacaacagccaaaattgacaaacgggatctaattaaagtaaacagcttctgcacagcaaaaaaaaaaaaactaccatcagagtgaacaggtaacctataaaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctagagaggatgtggagaaataggaacacttttacactgttggtgggactgtaaactagttcaaccattgtggaagtcagtgtggcgattcctcagtgatctagaactagaaataccatttgacccagccatcccattactgggtatatacccaaaggactataaatcatgctgctataaagacacatgcacatgtatgtttattgcagcattattcacaatagcaaagacttggaaccaacccaaatgtccaacaatgatagactggattaagaaaatgtggcacatacacaccatggaatactatgcagccataaaaaatgatgagttcatgtcctttgtagggacatggatgaaattggaaatcatcattctcagtaaactattgcaagaacaaaaaaccaaacaccacatattctcactcataggtgggaactgaacaatgagaacacatggacacaggaaggggaacatcacactctgcggactgttgtggggtgggggtagggggagcgatagcattgggcaatatacctaatgctagatgatgagttagtgggtgcagcgcgccagcatggcacatgtatgcagaggtaccagcatggcacattgtgcacaggtaccctaaaacttaaagtataataataataaataaataaataagtaaaaaatgattctcactaaatgttaataatggttattttaagagtagttagaatttgtggtgggtttttatttctttttttgtaattttgtattgctttaatttttcaaaacaaagatgtataatttatagaacaatagcaaagtcgttactccaagatcaataaaggaagagaccactaacaggaaaaacaacggaaaagcaagtgtggaatatatgggaccaaagaattttctagcctgtctcctgtatctgcagctggcttctttcaaactgtgtgagtgcctttataatgcaaataaaaggattaattcccctgatgttttgctactgagccagacctttacatgttcaagaatatggtcactatattgctgactatgtccacttaagttggaaataaaatgcgcaagtataatttttcaagatgtggtttgccaactagcagcactggcatcacctgggtatttgttagatatgcagaatcttaccttacctgacatactcaatcagaattttcatggtgacaagatcccctgaatgatctgtataaacatttaagcttgaaaagcactgctttaaaagatctaatggctcaattttccaataaggatattgaacagcggcttacataaagctacagagattaatcctatagtgggtttgcagaaaggagaaaaaaagattttttccgtgcacatgaaattattcattccacaatttagctgtgttttataggctatggggtccatctttggtgtggctgggcatccacacatttttaaacatattcagagtgatatcggggatttccaggaaaacagacacaacggttgatggttaaagaagaaaaaggaaagctttcttgtttgctggcttgttttgttagcgcaagatatgaagaatccggctgagggcagagttaattagcattatctaaagtgaaaaaaaaaataggattacctgcaagagatctcagcacttgtaattctttttccaaattgtctaaagtatgttgatcagtagtgtcatctaaggaaagctcattctggtcagtaatatcaatatattcaatttctgaaatttcagaagcagctctagatgatgattgagcagctgcacttcttgatcgaggatgagaggatgaaaggcaactggagctttctttaacagagttggaaagtggaaaatttgctgttgaaggtctctgtgatttctgacctaaaattaaaagtaaaaagtttttaaatcaacttttaaaaatttgaatgagtacttaaagatacaaaataccaggtccctgcacacagagaagttaagttcatgtaacagagtttatgaaaagttaactttgactatcaccctttctagctaaccacattttcttaatctcaaattacttttccaatgtcataaagaacacttctgtgtatttttttcctaattttcctacattcagaggaaaacaaactaattttaatattcacaaaggaaaatatctataaactaagtcaactttgtagagaaacaacacacaattttataacgtattccaaagccaagcaccacgacatgtgtcttaaattccaggacaataccaaacttaataccttgtaagaaaaaaaaccttagaaaaagcatcgtgccacttcctagtaaaccaattttacttgatgatatgtaatttattcttacatttaaaaatatggcaacaaaagagactaatttacaaaatctatatgaatatttggaaaaacacaggctttaaagaaattgagatcacgtctctaattttcctacggatgagctcactctcttctggaaaagttccagaagcaccgatctaaattaggttattacattgttcctctaggacagtcgctactttgtcttcacctgttttgaaagttgacttagttggtttcttcaacatgtttgctcctttaacagtaggaaaaaaaaatctcttcaaatcttatactaacacaacataactaatttctaatttggtatttctcacaaaatattacttaataaggccaagacagttttcaaggtacatatttaaaaattcatagggcaggtaaatgctttaatgtaataaattattgttctgatttaggtaaatatatttatagtaaacataattatattataagataactttgcactcccttaacacaaactggctttgtaaaactattaggtgggtgcaattgtcattatcataaaaaccctaatttgatggaacctatgccatataacattgttctcactctagtgactcaacaaaaaatataaaattcaaaaaagtgactacaggcggtaatcatgtattaaatatttaatgactattgagttgtttttggggggttttgggagtttttttggagaaggagtcttgctctgtcactaggctggagtgcagtggcacgatctcggctcactgcaacctttgcctcccaggttcaagcgattctcctgccccaggctcccaagctgggattacaggcgcgtgccaccacacccagctaatttttgtatttttagtagagatggggtttcaccatgttggccaggatggtcttgatctccagacttcatgatccgcctgcctcagcctaccaaagtggagtttgtctttttttaacttaaaaaaaatctacttcgaatgtgtctaatacctcaagaagactctcaatacagtatgtaattatttaagcaattaaaattggccaaggtaagtctcaaagggtaccaactttagtgaaaatttcagaaatcaatttttaaaataattttaattgaaataaaattatgagtaagttaaaataagactgatcttttgtgtctatttgtgctcagataaaaataatgggctaaaatatgcctaagtgttaaaaacatatatctatatctatatatatatataattatccctgagaattatttttatgactataagttagaaatgatttcctcttttatctataatatgtaaagaaccatatttatagcaatcaagaaccaaactctccaagtctacataaggaagcaatagcacaggcaatagcagtagctgcacaagtcagagagtgtaacaataattcgcaatataaatcaaaagttctactctatggggtaaaccacactttagtatctgtactatgatatgtctcaatcaaggtaaaatttaaaggaattcacaactctttaaaaaaacaaaccaaacgaaaatactatgagtaaggactggacttctgccaattcacagaaatgaagaaagaaaaatttaatataatgtagatgcccttcagaaaatctagaagagtacgaacactaataagaacatttgattgccacagtatttaaaggtaattgatccccattgagaaaaagtacacaaaggacaggtcagacttatgcttagcacacagcaaagaaacagaccatctttcttactggaaatatgctcaaagtgtaatttaaagtaactaaaacacagaaacagacagaagaggccccagtttgattcttgattttgtttattgttcttttaagccaatatatcattctttctaatgtttaatatataagggtactaatgttacggttaagtttaagatataacacaacattaacactggcactagttaaaaatgccatgattgaggggatcattccatattttttttaaaaaaaatctcaatttgtagattaaaagcataagaagttacttttggagtaacatgcgccatcactgtcaatgtaatcataagaaattattggttaacactgatcagttatattctaaatgtaacaaaataaattttccttggtgttaactgaagaatatatgctctatgattactaataaaactaagccaactattgggaagataaaattcaatagtgactttaaatcatattaatggatacaatattactggtaaggatataaaaaataggaataattcactgaatgataatcgttattgctattctaaatataacaatagaattagatgaaatgtaactatagcaacataattttaggtagcgttttaataacaaataatattcttatcaaaggacccagtattttgatcttaaataaagtttgcaaaacactgttgtctattgacattcatgtttcactgtatcaactgctgagaatttatacataaaaagaattcttagaaatgtattttctaagaattcttaaatttatatacaaattttatttagcagcatggttaagtggaaagaatactaaactaggtaactaagaatgttattgtgttatcttatagaattagaaaacagcttatgacctgtgaaatacaaaattcaggaactggatagtagaacgtcttaaattccttccaactctgagagcttgtgaattaatactcaatcaaattcaattataaaattatttatcaccctctaaaactgccaggcactgtgtcaggattggggtattcaaaagggaataagacatcacctccaccctcaagttgcactccaaactaacacacagttctactagcctactctactaattggaaaacacttactgagcacttacaataggccaggccctgttccattactgaagataccccaatgaacaggacagactagtccttgatttctttccaaccaagggtaagagaaagcaggaaaaaagctaataagatgatgttaaatagtgatagcttttacaagaaaaataaaagaaggtaaatgtgatagaggaactcaagagaccagcactagatagggtggtgccagaaggtctctctatggaggtagcatctggactgaagctgaataatggaaaagaatcaatcatatgaagagtgtgagaatggagagggaaatttcagagcatcctggagaagaggtaagatctaattctaaggctaagaagtgagtaagagagtggcttaagaacagaaagaaagtaaatgtggctacagtgtaggagaagatgcagttaggagagacgggtagccaaccaaggtgttgctgtgtgatacatggtaaggcatacttttttctactttctatagggatccatggaatgctttagacaatagaatggcatgatacaatatatggtttacatttatggaaagtacgattcacttcctataaactataaatatcaatactgttatgagtaaaaacaattcactcactgactataaatagtagaatataatggaaatgaattatagcaacatgattttgggagaagtaaaagtgaaaatgggagacaaatgagagatgaagacaaatggcttggactaatcttgaatagtgaaggtaaaagtgtttagtgttgggcttgattttagagctgaaatcagcagaatctaaaaataaataggatacactgagtgagaggcaagatgactcccaaatttcagacttaatcaatgtttggatacagttgccatttccagaggcaggaagatgggctaggggaggattaagttgtggcagggatgagaagaatgaataaacttgctgctaaacacacatagctacgatgtttttacattcatgacttcttaattgttatggaaatgggaattcctctatatactggcatcagtgcagaatacaagatttctataacttgtgacagagccaggcaatttttagtttattttagaccattgtctctgttcagaaagccatttcctaccttctctaactggtaaatattataactttttaaagactcaactgaatgttacctagtctctaatatcttgccaatctacacttttcaatagcaaagtcattatgttatcatctctatttctaaaaaaaaaccttgcttatatatctaactattatagctgataggacatattatcattaattacctattaaggtccaaaagtaaattactcataggtctttttataaaacttatatgtggtataatttacatattcacacacacattttatatatatcaaaaaatttatagcacttttctcaaaatatggtattcagactgtttatattagcataacacggagttgttgttgttcagaaaataaatgcaatttcttaggcattacctcagccttaattaatcagaatccctaagagtcagatccagaaatctgcattgcaagaggtttcccaggtgattatgcccacagcgacttttgagaaaattttatactggactctaagctcttaagcaatagagataagagtttgttttgtataaacagtgtctggcagtagtgcttgaacaaatgttttttatagcaaattattgattttgactgatctgtccaaattgatacttaaaagcatttgactatggatttgtagatttgtctttgtaataaatttctcatagcacgtatatgaatttgttttcatcaatatacagtgacttaaagcagttctttctgattgcctcagagggaagcaaccagaatttttgaagttgctgtcgactttgatgtaaaaataggcatctaagtatagagccaaaaaaatcataaatacattgttttctccctaaaaattttatatctgacagattctcaacataaatgcacatggaaaggatctaagatagccagagagttttaatcatagattttagggcaagagagacatatatatcttatatagagaggcaaatcatatgcaattaaatttctgccttgaagatagcctttaaaccaaggcaaatagccccctttctcaggtattcctcctaaactgtgagctcaataagatcagggaatattacttacatatctcttttatcctcggggccaatccaagtgctaatatcctcaaaatatatgctgaattacctgaattcattagttgtctactacaacttcctactttggcatagagcaaacccactatagctggtataatgggataacagtaatgtcctaataatagtagtgattttaatgatgttatatgctctgtatacactcattaggaaagtatcaaaatagatattcagtatgtcaaaagaattattctatggaaaatcttataattactttgtttagagaatagaggtaatgaactgaaatgaagattccagggtcaatgcatacagaattatatttagaactaagctttctcaatcccagcaagaaacagcatcttaacctaagtcaatcatttcacatatggctctgtctgatcataatatatatcaagtgaaagagtatgcaaaatctggtataaacatactgcttcctgagtgagtaatgaaaccatgtattttataaggattgttcaaaatatgccatatccttaactacattttgcaaatattatttcctaatacattgttatagaaaataactaagatgataattcatgcctttggaaaaatgagctcacttgtttttatgctttggttttggaagaaaagtcgaggacatttagttaaaatgaatgaatttaaattacagaacttcaaaaactaaattgcaggtgcctactaaactgctaaaaaagcaaactactaaaggaagtaagctgccaacatggcactgctgcctttgagtcaatgttacccatcttttgctgttttctacttgatgatggactctgagcaccctgcagaacacccaagacaattgcattatcagcatattcacttaagctatggtctggaatccattctctgtcttctgaaattgaaaaacagtaagataacataaagtttgaaaagaagaaaatccattttattagttttatatttatgtcttactggacaatatttaactgaataaagaatatttacaacagtgatatatattatgaaatacaaaatcttattacaaaataaaaatcattaaattaatatattttaattttaaaaatttaaaaagtatataacaatgcaacataaagtataattgtttctacatgaataaacacatttgaatacataagatgcctaagaatatagatgacaccaagatctagctttcaaaatggaaactaaaaaatcatgaagagaagatggccaaataggaacagctccagtctgcagctcccagtgataatgatgtagaaggcaggtgatttctgcatttccaactgaggtacatctcattgggactggttcatctcattgggactggttgtacagtgggtgcagcccaaggagggcaagccaaagcagggtgtggtgtcaccttacccaggaaggaaaggaactccctctcctagccaagggaagccattagggactgtaacttgcactctggctcggatactgtgcttttcccgtggtcttcgcaaccctcagaccaggagatcccctccggtgcctacaccaccagggaccttggtttccagcacgaaactgggtggccacttgagcagacaccgagctagccacaggagtttatttctcatacccgagtggcacctggaacatgagtgagacagaagccaggggggtgaagccagggagccaagtggtctggctcatcggttcccaccctcatggagtccagcaagctaagatccactggctggaaagtctcactgccagcacagcagtctgagctcaacctgggatgctcgagcttggtgaagggagaggtgtctgccattactgaggcttgagagggtggttttatcctcacagtgtaaacaaagctgctgggaagttcaaactgggcagagtccactacagctcagcaaagccaccatggccagattgccttctcaagagtccctccctgaaaaaaaggcagaagccccagccacagacttatagataaaacctctacctccccgggacagagcacctaggggaaggggcggttgtaggtgcagcttcagcagacttaaacatccctgcctggcagctctgaagagaacagcagatctcccagcacagcgtctgagctctgataaggatcagactgcctcctcaagtgtatcctgattgggagacaactcccagcagaggccgacagacacctcttacaggagagctctggctggcatctggtgggtgcctcactgggacaaagcttccagaggaaggaacaggcagcaatctttgctgttctgcagcctccgctggtgatacccaggcaaacagggtctagagtggaactccagcaaacaccagcagacatgcagcagaggagctggactgttagaaggaaaactaacaaacagaaaggaatagtaacaacatcaacaaaaaaaacatccactcagagaccccatctgaaggtcatcgacttcaaagaccaaaggtagataaattcacgaagatggggagaaaccagtgcagaagggctgaaaattccaaaaacctgaatgcctcctctcctccaaaggatcacaactcctcaccaccaagggaacaaaactggacggagaatgagtttgacgaattgacagaagtaggcttcagaaggtgggtaataacaaactcctctgagctaaaggaccaagttctaacccaatgcaaggaagctaagaaccttgagaaaaggttagtcaaattgctaactggaataaatagtttagagaagaacataaatgacctgctggagcagaaaaacacagcacaagaacttcatgaagcatacacaagtgtcaatagctgaatagatcaagcggaagaaagtatatcagagattaaagatcaactcaatgaaataaagcggaaagacaaggttagagaaaaaagagtgaaagaaacgaacaaagcctccaagaaatatgggactgtgtgaaaagaccaaatctacgttttattggtgtacctcaaagtgacggggagaatggaaccaagttgggaaacactcttcaggatattatccaagagaacttccccaacctaccaagacaggccaacattcaaattcaggaaacacagagaacaccaaaaagatattcctttagaagagcaaccccatgacacataatcctcagattcaccaaggtttaaatgaaggaaaaaatgttaagggcagccagagagaaaggttgggttaccgacaaagggaggcccatcagactaacagcagatctctcagcagataccctacaagcagaagagagtggggatcaatattcacatacttaaagaaaagaattttcaacccagaattttacatccagccaaactaagcttcataagcaaaagagaaataaaatcatttacagacaagcaaatgctgagagatcttgtcaccaccaggcctgccttacaagagcttctgaaggaagcactaaatatggaaaggaacaaatggtaccagacactgcaaaaacctaccaaattgtaaagaccattgacactatgaagaaactgcatccactaacgggcaaaataaacagctagcatcataatggcaggatcacattcacacataacaatattaaccttaaatgtaaatgggctaaatgccccaattaaaagacacagactcacaaattggataaagattcaagacccatcagtgtgctgtattcaggagacccatctcacgtgcaaagacacacataggctcaaaacgaaagaaagcaggaaattttaccaaccaaatggaaagcagaaaaaaagcaggggttgcaatcctagtctgtaataaaacagactttaaaccaacaaagatcaaaagagacgaagaagccattacataatggtaaagggatcaatgcaacaagaagagttaactatcctaaatatgtatgcacccaacacaggagcacccagattcataaagcaagttcttggagactacaaagagatgtagactcctatacaataatagtgggagactttaacaccccactatcaatattagacagatcaatgagacagaaaattaacaaggatatccaggacttgaactcagctctggaccaagtggacttaatagacatctacagaactctccaccccaaatcaacaggatatacattcttcccagcatcacatcacacttattctaaaattgaccacataattggaagtaaaaccctcctcagcaaatgcaaaagaatgaaaagcataacagtctctcagaccacagtgcaatcaaattaggaatcaggattaagaaactcactcaaaactgcacgactacatgaaaactgaacaacctgctcctgaatgactctgggtaaataacaaaatgaaggcagtaatgaagatgttctttgaaaccaatgagaacaaagacataatgtaccagaatctctgggacacatttaatgcagtgtgtagagggaaatatatagtactaaatgtcctcaagagaaagctggaaagatctaaaattgacatgctaacatcacaattaaaagaattagaaaagcaagagcaaacaaatgcaaaagctagcagaagacaagaaataactaagatcagagcagaactgaaggaaatagagacacaaaaaacccttcaaaaaaccaatgaatccaggagctgtttatttgaaaagaccaacaaagtagatagaccactagccaaactaataaagaagaaaagagagaagaatcaaatagatgcaataaaaatggcaaaggggatatcaccaccgatcccacagacatacaaactaccatcagagaatactataaacacctctatgcaaataaagtagaaaatctagaagaaatggataaattcctggacacatacaccctcccaagattaaaccaggaagaagttgaatccctgaatagaccaaaaacaaattctgaaattgaggcagcaattaatagcctaccaaccaaaaaaagtccaggaccagatgtattcatagccgaattctaccagaggtacaaagaggagctggtaccattccttctgaaactattccaaacaatagaaaaagagggacgcctccctaacctattgtatgaggccagcatcatcctgataccaaaacctggcagagacaaaacaaaaaaagaaaatttcaggccaatatccctgatgaatatctatgcgaaaatcctcaataatactggcaaaccaaatccagtagcacatcaaaaagtttatccacaatcaagtcggcttcatccctggatgcaaggctggttcaacaaacgcaaatcaataaatgtaatccatcacataaacagaacaaatgacaaaaaacatatgattatcttaacagatgcagaaaaggccttcaacaaaattcaacagcacttcatgctaaaatctctcaataaaactagctattgatgaaacatatctcaaaataataagagatatttatgacaaacccacagccaatatcatatggaatgggcaaaacctggaaacattccctttgaaaaccagcaaaagacaaggatgccctctgtcatcactcctattcaacatagtattggaagttctggccagggcaatcaggcaagagaaagaaattaagagtattcaattaggaaaagaggaagtcaaattgtctctgtttgcagatgacatgattgtatatttagaaaaccccattgtctcagcccaaacctccttaagctgataagcaacttcagcaaagtctcaggatacaaaatcaatgtgcaaaaatcacaagcattcctatacacctataacagacaaacagagagccaaataaagagtgagctcccattcacaattactacaaagagaataaaatacctaggaatacaagttacaagggatgtgaagaacctcttcaaggagaactacaaaccactgctcaaggaaataagagaggacacaaacaaatggaaaaacatttcatgctcatggattggaagaatcaatatcatgaaaattgtcctactgctgaaagtaatttatagattcaatcctatccccatcaagttaacattaacttcttcacaggattggaaaaaatttactttaaatttcatatggaaacaaaaaagagcccgcatggccaagacaaccctaagcaaaaagaacaaagctggaggcatcacactacttcactttaaagtatactacaaggctacagtaacccaaaacagcattgtactggtaccaaaacagatatatagaccaatggaacagaacagagccctcagaaattatgccacacatctatagccatctgatctttgacagacatggcaaaaacaactaaaagaaaaggactccctatttaataaatggtgttgggaaaactggctagccataggcataaaactgaaactggatcccttccttacaccttatacaaaaattaactcaagataggttaaagatttaaatgtaagaacgaaaaccataaaaaccctagaagaaaacctggcaataccattcaggacataggcatgggcaaaggcttcatgactaaaacacgaaaagcaatggcaacaaaagccaaaatagacaaatgggatctaattaaactaaagggcttctgcacagcaaaagaaactatcatcagagtgaacagacaacctacagaatggaagaaaattttggcaatccatccattggacaaagggctaatattcagaatctaaaaggaacttaaatttacaagaaaaaaacaaacaaccccatccaaaagtaggcaaaggatatgacagacacttctcaaaagaagacatttatgcagccaacaaacaaacaaacaaaaagctcatcatcactggtcattagagaaatgcatatcaaaaccacaatgagataccatcttacgccagttagaatggtgatcattaaaaattcaggaaacaacagatgctggagaggatgtggagaaagaggaatccttttacactgttggtgggagtgtaaattagttcaaccattgtggaaaacagtgtggtaattcctcaaggatctagaactagaaataccatttgacccagcaatcccattactgggtatatacctaaaggattataaatcattatattataaagacacatgcacacatatgtttattgcagcactgttcacaatagcagacttggaagcaacccaaatgcccatcaatgatagactggataaagaaagtgtggtacatatacaccatggaatattatatagccataaaaaaggatgagttcatgtcctttgcagagacatggatgacactggaaaccatcattctcagcaaactatcacaagaacagaaaaccaaacaccacatgttcccactcataagtgggagttgaacaatgagaacacatggacacatcaaacactggggcctgttggggggtggtgggataagggagggatagcattaggagaaatccctaatgtagtgatgggttgatggatgcagcaaaccaccatggcacgtgtatacctatgtaacaaacctgcatgttctgcatatgtacccagaacttaaagtgaaattttaaaaaaaaatcatgaagaaacaaaaaattggaatatatatatatatatatatatatatatatatatatatatatatatataaaaaaaactagtaaggagattaaatctgttaacaaaaatttgccaataatgaaaagtcctggacctaattgcattagtggtgagttctatcacacatttgaagaaataacaccagtcctcaaacttttccaaaagattgaagaggagggacatcaactcgttgatactaatgccaaataaagacactacaagtaaagaaaacatcagaacaatatcatttataatcagtgatgtaaaaatcttcaaagtacaagcaaaccaaattcggcagcatattaaaaacggttatacatcatgatcaaataaaatttatttctgaaatgtaaggatggttcggcatatgaaaatccatcagtgtaatacactacatttatagaatgaaagaaaaaaacacataatcatctcaatttatgcagaaaaagtatttgacaaaatccaacacacttttatgataagaacaaccaacaaactaggaataaaagggaaatgcctctacacaataaaagtaatatgctaataacccacagcaaacatcaaactcaatggtgaaaaatagaacatttctaagatctagagcaaggcaaggatgcctgcttttgctacttctattcaatataagtagccagaacagacaagaaaaagaaataaaagacatttgaattagaaaggaagaagtaaaattatctttgttcacagatggtgtgatcttatatgtagaaaacactaaagattccacaaaaatatgttagaataaatgaaatcagcaaagtagtaggatacaaagtcaataggcaaataccagttgtatttctatatgctaacaatgaacaatcggaaaaggaaattaaagaaacaattccattcacaacagcctaaaaaagaaacaaacttagaaatcaacataaccaaggaggtggaagacttatgcaatgaaaactataaaacattgctgaaagaaattaaagaagccacacataaaaagaaacatatctcatgttcatgaactggaagagttaatagtggtaaggtgccaatgttacccaaagtgatctacacattcaatataatccctatcaaaagctcaatgacatttttcgtagaaataaaaaaacccatcataaaattcacatgcaatcaccagggaccctgaatagccaaaacaatattaaaaacaagagcaaagctggaagactcacactttctgatttcaaaacttattacaaagatactgtaatcaaaacagtgtgataccagtaaaaagacagacatacagaccaatgaaatgggataaacaacccagaaatatatcctccctcacatatacaatcaaattataatgattttttaaaaagtatccttatggtataaaacttattttgaaatatgtatatattgtggaattgctaaatcaagttaattaacatatgtattatctcaccaatcatttttttgtgtgtgtggtgagaacacttaaaattcactctctcagccaaataatttttgacaagggtgcctagaccattcaatgggggaaagaaaggtcttttcaacaaatggtgctggaaaacttgatatccatacgcaaaataatgaatctggacctttgataccatgtacaaaaataaactcaaatcgatcaaagacctatatgtaaaacctaaaactacaaataccttagaagaaagtataggcccaggacattggctttggaaatgaattcttaaatatgacactgaaggaacaggcaagagcagccacaaaagtagacaaattggacttaataaaaactggaaaaaaactgcatccaaagacactatcaacagagtaaaagggcaatccacagaatgggaggaaatagttgcaaataatatatcttaagaagaagcagtatccagaatataataaggaactcctataactcaacaatgaaaaaacaaataacccaattaaaataagagctaaggaattgaatagacatttctccaaagagtatatacaaattacttattaagcacatgaaaagatgcttaacattattaatcattaggaaaatgcaaatctaagctacaatattgtaccacctcagacccatgaggatgactattctccccccgaccccaccaaaaaaataaaagaacaagtattgtcaagaatatgtaataatcggaacatttgtgccctgttggcagtaatgtaaaacaccaaccagatgctggcaccatactacttatacagcttgcagaactctaagccaaataaacttcttttatttataaattatgtagccttggttattcctttacagcaacactaaaaggtctaaaataaccacacttctaaatgctaaaaaatctttcctagtttcattgtaagtcatagtttctcacattctgatagtaaccttaaatgtaaatatatggcaactaatacaaggttaataattttaggctggcaagaagaaaatgattttatccattgaacagaattgctcagtatttcctaagatgagaacagactgttttagaaaaatgagctagaaatttacctgcaagtgtaatcctagtactggaattgttgcattctaaacgatgagaaggaagtaagttgagtctttcatttgtatcaaaaataaagaatctctcaagtccttgatattgttttgttataggcttacttctgcaggctatttcttgtaacaactaagaaacaaaatattcaacaatattattttctaactcattaacacaaacaagcatattcatttatcagatacctacttggtatctgatatacttggcacaaattcttccctcatcaagtttagtttctaacagtggagacaaataataaaacaacatttatatataggaagttctaactacagttacagtaattctctgaaagttgatactaatccaaagaggacagaagttcatgaaataaaataaactttttttctctttcttcctttattttcatccctcagtgtctttgcacataaattatcctggaatacagagttactttcacacgcagtggctttgaactagtgtctttgtctatatataaaataatttcaaaactgaaggtgaaataccaatgggaactatctgccctgacaatggtcatggaaaaaaaaatgtaagttaacaaaacactcatcatgaagcaaatataaagtaggaaactgtggcaagaggaagataagtaatttatgacgtttatatagctagaaactagcagacctaggctttgaatataggtctgcctgatttgaaacctagacttatcctgccaccctattaattcatttttacatgttcttattctaggattgaatataactgggattttaaaaaatgtgaatccagtagaaacagattaggaattcattagtaagagctctagatgaggttatagtataatcagagtagctatcagtttttaataattccgtaatgaatctaactaatgcccaaatatagtctgttcccataaatcaatgtaaagcaacttgctttaattttttataaatttataaattatataaatgagatcatattaaagaacaaagctagtgaccaataaagcatgtcattcaaagacaaatcgaaatcaaaattctcagcacatatcccctggccctcccagacaccaataaacaattacagaattctttccactctactgaagcttatatttgaattatgcaatcgcaaatctggaagagttttgaatgtcttggtttacagataaaaatcctaaaatagttatgttttgtctacttttagcacaaacttacaaagttaactattgatagttttagagccagaacaaaggacccctaactagtccattgttttcctaactactgccctacaaattagtacttaattccgtaggaagtactaccttacacagaaatcattttctgaaaactgaagtacaaaatgaacaattttatactcaatttggatggagcaccatagatttctaagtcatttcttctgatggaatggcttctactaggacagaaaaagagggaaataggttcaggtatagttcttaggaatgaaaagaaagtagattcaaccactttattcagaagcaggaactcagtctgcaaactgtgaagtaccaattatgatggccactttagaaagctctattttacagctcccctccacctgcttttcaccttttgttttgcaactcttcaaattctcttgtgatccaacaacttaattatttatagagattggccatctcctataataagatgctcagggagaacctttggcactcagcttaagtcctgtcttaccagtggtggaaaatttctgtgaaactatttacacttttttattcctcagatataattacctaggaatggattaaaacattattttatttataaaaggggcaatcctggagtcagaaacccattagtttgttgagaattcttttaaaatcctatgacagattattcctgaaaaaacttcaaatctctcaatccaatatcccccatgaggaaaaggcaagctttacctaacactattttattactgtccaggactacctttagtctcacctaattgaaaaaaaacaataaccatgtaagccattttacaacagtcactggtttttgattatgtcagcagctttgagctgctgagaactttatggatcctatgcacttaaacactcattcagattgtttcctgaactagctctgtcagaacatattttacactgagcaatattttatactgagcaatggatagtcttaaattgaataaaacaagaatgtataccagccacacacacattcccatctcccccaccaaccctttttttttttttttacgagataagagtctcaccctgtcacccaggctggagtgcaatggcgcgacctcagctcactataacctccgcctcccgggttcaatcgattctcctgcctcagcctcctgagtagttgggtagttgggattacaggcacctgccaccacgcccagctaatttttgtatttttaatagagacagggtttcaccatgttggccaggctggtcttgaactcctgaccttgtgatccacccacctcagcctcccaaagtgctgggattacaggcgtgagccactgtgcctggccttttttttttttttttttaacttttaagttcaggagtacttgtgcaggtctgttacataggtaaatttgtgtcatggagatttgttgtacagattatttcatcacctaggcattaagcctagtacctactagttattttttctaattctctctctcctcccactcatcaccctctgataagccccagtgtatgctgttcccctctatatgttcatgtcacacaccttccttttaagaaacatctaaacttagtgacacacctgttacattaattgaatagagtagtatgcattaacatataaaagaaggaaaggaaccctgctgtaaattattggtgctatgtaagtcacagctatcctgacagactctgatcagttgagagtagaccaggaattcaatgggatgcaaatcatcagactatctaactaaatgaaagattccctgagaaagtggattggataaataggcagggcctgagggcaatacatgtttccttatcctctcctactgaattgaagagaacggcaggaaagagttttcccagtgaattcctttgagtttattactgctttattacttttgagtcagattcatagttcattaatttttacttttttcttgcatttgggattataaatttcccagtaagtagtatttgagtttcatcctatacattatttacctgtgatgtttttgcttacattcagttctaaatatttctaccttctattttaattttttcattaacctggacatatttggacgggcgcagtggctcatgcctgtgatcccagcactttgggaggccaaggcggttggatcgcgaggtcaggagatcgagaccatcctggctaacacgatgaaaccccatctctactaaaaatacaaaacgttagccaggcgtactggtgggcgcctgtagtcccagctacacgggaggctgaggcaggagaatggcgggaacccgggaggcggagcttgctgtgagccacgatggcaccactgcaccccagcctgggcaacagagcaagactccgttaaaaaaaaaaaaaaaaaaaaaaaaacctagacatatttgaattgtattaattttgttagcattttgctatcgatttataatttattgtattatggttggaaaacaccgtgtgtaatatgatttctttagcatttgttgaaacttcctttgtggatttatttttgtaatgtgttgtaacatgtattttgtaaatgttccatgtgttcttacaaagaacacacattctctaattattgagtatgtggttcaaaatatgttctttaaacttatttgtattgatcaaatcttctctatctttactaatagaaaatcttattggattgatggatttgtcaataataccatgtggttttgtccatttttgctacaatatatctgaggctatattgataggtacatacaaattcagatttcctttaatctttctattaaatagttgattttatcatgtacataatggtcccctttaccctgataatgttttattaccttaaatttttttttaaattagtgcttgcctttactctgaaattcctccccccaccccatgttttaagcaggtttctggtaaaataactatacacacacacacactatccacatttattctaattacttatatgattgggtttattcccgtcagctttactctttctacttgctgtcaagaattgtgaagggtctgagattttatcctacgtgcaagcctgttatagtttcatggatgctggacgaagacacaagactccttggtcagagacaaatgactttatcactcacaacaatagcagttgccagagtatcatcatttgcaccaattcccagaacccagttttcacaggacatcatgaagagagccacgtgacatctgcacataccctgagctgtgttacaggagagaaatcctgatcttaggaaatccaattattttatactgggcagtaagcctgcctgacctttgccagaggaaaacattatttttattacaccagacagtaaacaaacctagtctttgctctgaagagggacataatctctatatttcaaggctgttatctatacaagcacccttgaaaatatactttggaacaaatagagtcagtggttttgctcaaaagatgtgcaaaaaaacatgagagacccaagaggaattgtacacccaatacttaactatactatttttcctttgatgcatttatttcctgactgttttaattaattggattttctatggtccccttttcctttagtattttggatgacatacattatgtctgtaacattttaattgttactcaaagtatttaacatgtataactaaaacactaagtcaacaatccctacaatgatctctaccttcctttataatacagaatcttagtacttttaactctaatcatacatatctaacagtcttacaagttatggtacatattatcctcattcaaatttcttcttttataattctcaaattgggcattctaataattattttgtaatacatctaatatatttgccattttcccctcacaccattatttcttgcatcctacttcttccttccaggtttaatttcttccttttttaagtatatcattcagatgttcattcaagaggcgaaataactaaattacctgaatttttctctaaacttgccattattttattcttggtcttgaatgaaagttttgcaagccttagaattctagattgttagtcagttctattggaagtttaaagataatgttccactgtgttacactgttgaggctatctgttgctgtgcatgagaatttaatgtcaatctagtaattgctctttggagataattatctgttgtcttttattgcttttaagattgtctatgaggtatctcaaaaataagtcataatgcgaatttgtttttatttatattgttcaggaattgtactttgttatttcacaatctgtcatattactaactcttcatatgtctttgctgcaatacaagcaattttttaaacttatcttccagggtaatatttctctccttatttgtatttaatatgctgtttatatccattttattataatttgaataaatatatttcgaatgttagaaatttttattggccttcataaatggagcagtccatactgtcttattcttaagttctttttatttcttcctttctatttttaaacattttaaatatagtctcacaggatagagattgagtctctctctctagagcaaagagcaggtttgtttactgtctagtgtaatgaagatagtcttcctctaggacaaaggtctggcaggcttactgcccagtgtaaaagatcgggtttcttaaggtcaggattcctcacttattacacagctcactgtttatatagatgtcacctggtactcttcatgttgccctgtggaaatctggaaattgaagttcttgttttctctgctgaaatgcatgctatgatcaatcgttttcttcactgggggaacgagaagataagcccatctgaagtggagctttattttgtggaatctattgtgggataaggtgtaagcatgtccttttataaagtattagtacttacttctgtcagatacatcaggatattaataggcacggattaacaataatgttaatgtcttggcttcaagtttccaagcaagaaatacatatgcaaatgtatatttgggtatgtatatccaaacctatgctaaatgaaagcccaagatatctattttccaggtgaaacgttttattggcctagcccagatcacttgcagagatcagtttcctttcatcttgttgcacctatgggtatgttcctagtgcactcctttaatgactgatcagacatttaggggtctaagtttttgcagaggactcagttccaatttcttatctcacaaaggtacaatatctgccacaaagtgggcacagaaagccaatcctccaagcagaagtagcagcaactcaagtattcatccttctgcttttttgcttccctcttcaggaaccataggaattcattttaaatgacttttaagcattgttaaaaatgtttgcctcacttaaatttcctaagaatgtattattaataattacaattagtaaagatttctagtatatagaatgaaattcaaatatagttttaaaacatggtaacaatgcaataatgagctactttacctttcctatgagaagaaacaaaatctacacctctatttccttattagccatcttcctgaaagaattaccttcttcatcttatacttacattaaaccacagtaactggttctgtctagatatctgcatttatttcattttgaccattgactatattatcggaaaaaactagaaagtatttattatactgtattattcataatgaatttcatttggaaaagttgttacttttccatgctcttactatgctgcataaggtgggccttaaagtatcatttatcacagaaagccatttattaaaatggcattcctcatattagaatttgtcctagaggccattaatgttctctcccgtatgagtcactcttcaactatctcataataatataaggcagcacattttaactttaataggaagtaacttgagaatgtattgtgtcactaagacattttcttatgaggtttcttataaaattttaatataataaacataatagagatttaccagtgatgactttgtagtttttgattcttcaaagcttggcctcttatacagattgctcaattccaaggattctttgatgtcttgagataatttctcctcaatgggagctttttctaaatctctacctagcaaagtgtccttgctttcaagtgatacacaggaatcatcagacttttgattactttctaaacctatatttttctcctttaaatttctttcaaaggaggtgctttcctcaattttttcaatgtcagaagaatacacatcaggatccacgatgttgtcaaaatctgtgtttgaagtttctgctgttaaaaacacacagttacaaaaggtacataaataaatttaaacaaataattaaactgttaataaaccaaaagttctgtggtaaaaaaactttctcaataaacactatttcacaaattcctttactgatgttttagtgttaaaatatttttactatgcttatattcataagtggtaatcataattcacttatagaaccaaacattaatgagctagactagtaaaagaaggtaatattttattttgcaatgaaatcttaaaattgatgcaaatttttatttcagcctgtggttcaattctcactttcccacctcctcctctcactcaaattttacaacagtaattcatgagaagtaacacagggggaacattttttcattttgccatttttccctagcatgcctagcaataaagagagggcacagggaaatgtgccagatgaaagaagagcagcagttgggggcacagaaaatgtgtagcagggacacctgcttctagaaagctacaaagtgaacaagattgtattagtcatctacctcattatgtctgctttaaataaatcatttggtttacatcaccggtttttaacctggttgcacagtagaatcatctgaaggcactctttaaaattgtcagtgtatgggcctgaccccaaaccaattaaatcagatcctgagagtggaactcaggcattggtcttttgaacttccccttgctaagttgtccaggtgattatagtgggtaacacagtagtgaaacactggtctagattttctgaaaaataaaaattctttgaatgtttataccatactactttcattttaaataaatgtacaccattatccagactgaatatagcttcttctggttatcccttactctgttccaaagacaaatatctctataagtagactatgtaaaatagtagaaactctgaataaaactgtctcctgtgatgtaaatgctttacagctttacaaaggacttgcttgttgcaatcaaatgtttatataactcaccaatttcagatagtatttagaactagtggaaacaaggaagtcaaaagtacctctctccataagacacacccacacaggtgcagaaaaggctttcgacaaaattcaacattcattcatgttaaaatctctcaataaactaggtattgaaggaatatatctcaaaataataagaaccatatataacaaacccagagccaacatcatactgaaagggcaaaagtattccccttgaaaactggcacaagacgaggatgccctctctcaccactcctattcaacataatattggaagtcctagcaagggcaaccaggaaagagaaagaaataaagggcatccaaatagtaggagaggaagtcaaactatctctgtttgcagactacatgatgctaaatccagaaaaccccatagcttaagcccagaagcttcttaagctgataactttggcaaagtctcagaatacaaaatcaatgtgcaaaatcactagcattcttatacaccaatgacagtcaagctgagagccaaaagagctccaatagctaaggcaatcctaagcaaaaagagcaaaactggaggcatcatgctacccaacttcaaactatactgaagagttaccaaaatagcatggtactggtacaaaaacagacacatagaccagtggaacagaatagaaaacccagaaaatagaccacacacctacagctatctgaccttcaacaaacctgacaaaaacaagcaatggggaaaggattccctattcaaaaaatgatggtgggataactggctagccatatgctgaagattgaagctggaccccttccttataccatatacaaaaattaactcaagatagattaaatacttaaatgtaaatcccaaaactatgaaaaccctggaagacaatctaggcaataacattcaggacatgggtataggcaaagatttcatgacaaagatgccaaaagcaatagcagcaaagcaaaaattgacaaataggatccaattaaactaaagagcttctgtacagtgaaagaaactatcaacagaataaacggacaaactacagaatgggggaaaacttttgcaaaccatgaattcaacagagctctaagaaccaccttctataaggaacttaaagaaatttgcaagaaaaaagcaatctcaataaaaagtgggcaaagacatgagcagacactttcctaaaagggacatacatgtgaccacaatcctataagaagaagctcaacatcactcatcattacagaaatgcaaatcaaaaccacaatgagataccatctcacaccagtcagaatggatattattaaaaagtaaaaaaaataacagatgctggtgaggttgtgcagagaaaggaacacttatacactgttggtaggaatgtaaattagttcaaccatcatggaagacagcatggtgattttcaaagacataaagacagaaataccattcaacccagcaatctcattactgggtatatacccaaaggaatataaatcattctattataaagatacatgtatatgtatgctcaatgcagcactatttataatagcacagacagggaatcaacccaaatgctcattaatgacagactggataaagaaaatgtggtacatatacaccatggaatactatgaagaaaaacaagatcatgtactttgcatggacatggatggagctggaggccattatccttagcaaactaacaaaagaacagaaaactaagcactagtttataatttataagaggaagctaaatggtgagaacacatggacactttagaggggaacaacacacactggggcctattgaagggtgagggtggtaggagggagaggagcaggaaaaatcactaatgggtgcaaggcttaataaatggatgatgaaataatatgtacaacaaacccccatgacacaagtttacctatgtaacaaaactacacgtgtgtccctgaacttaaaagttaaaaaaaggcatgcctaccagtgacatgtcagtttaccactgctatggcaacatctggaagttatcacctgtttccccagcaacaacctgatgacccagaagttgccaccccttttccagaaatttctgagtaactcatcttttaatttgcatgtaattaaaagtggctaaaaatattactgcagagccacctctgagatgctactctgggtacagtgcttatggggtaaatctgttccaaaaggaacactgcctttgccactgctgtacactgctactttaataaaacttgctgtctaacaccactggcttgcatggtgcaagctgtcagtggatctaccattctgtggtctggaggatggtggctctcttctcacagctgcactaggcagtgccccagtggttactctgtgtgggggctcctaccacatatttcccctttgcaccactctagtagaggttctccatgagtgctctgcctctgcaacagacttctacctggacatttaggcatttctgtacatcctctgatatctagacagaggtttccaaacctcaagtcttatcttctgtgactcacaggcccaacaccatgtggaagccaccaaggcttggggcttgcaccctctgaatccaaggtccaagctgtatcttggccccttttaaccctgactgcacttggagccactgggacagagtaccatgtcttgagggtgaacagagcagtgaggccctgagcctggcccatgaaaccatttttcccttctaggcctacaggccagtaatgggaggggatgctgtgaggatctcaggaatgccctagagacattttccccattgtcttggcaatcaatagttggttcctctttatttatacaaatttctgcagcatgtggctcgaatttctccccaaagaatgggtgtttcttttctaccacatggtcaggctgcaaattttccaaacttttatgctctgcttcccttttaaacataatttccagtttcataccatttctttgtgaatgcatatgactatatgctttttgaaacagccaggtcacatcttgaatgctttgttttgctgcttagaaattccttctgccagatgctgtaaatcatctctctgaagttcaaattccacagatgtctagtttgaggagggggccaaaatgctgccagtctctttgctaaagcatagcaaaagtgaccgttacttcagttcccaataagttcctcatttccatctgaaaccatctcagcctagacttcattgtccattatcactataagcattttggtcaaaatcattcaacaagtctctaggaagtcctaagctttcccacatcttcttttcttcttctgagccctccaaactgttctaacctctgcctgttaccgagttctaaagtcacttccacattttcaggtatctttacagcactacttcacttttctggtaccaattttctctgttagtccatttttaaactgctataaagaactacctaagactgggtactttattaaggaaagaggcttaattgactcacagttccacatggctgggaggtctcaggagtcttataatcatggcagaaggtgaaggggaagcaaggcatgtattacatgttggcgagggctggggatctgccacacacttttaaatcatcagagctcacgaggactcactcactatcatgagaacaacatggaggaaaccactcctatgatccaatcacctcccaccaggtccctcccttgacacatggggattacaatttgagatgagatttggttaggaacacagagccaagccatatcatagatagaaatctaaaaattatatacaagatctatatgaggaattctacaaattctgattaaagaaatcaaaattctaaataaatagagaaatattctatgttcatggatgggaagatttaatattgttaagatattttttcccaacttgatctatagattcattgcaatcccaatcaaaatccccgcctttttatagagaaacaaatgacccaggatagtgaacacaatatcgaagaagagcaaagtcagaagacttgatactaccttacatcaagattactataaatctataacaatcaagagagtgtgtggtattggaataaatgtagacaaatagataaatgaaacagaatagagaatcctgagtagacctatataaatacagtcaactgatctttgagagaagaataaaggcaatacaacaaagaaaatataatctgttaagcaaatgattctggaacaactggatatccacatgtgaaacaatatatatagacacagaccttacaccttcacaaaaattaactcaaaatagattacacacctgaatataaaatgcaaagctatgaatctctcaaaagataacataggataaaacatagatgacactggctatgacaataactttctagatacaacatcaaagaaaaaattgataagctaaactttattaaaataaaagcttatacactatgaaaaatagtccagagaataaacaggcaatccatacactgaaagaaaatatttggaaaagatatttgataaaagagtgttatgcaaaacatacaaaaaactcttaaacctcaacaataacaaaataaacaacccaatcaaaacattagctaaaaacctgaacagatattttaacaaagatatacagttggcaaataagcatattaaaagattctcgatatcatatgtcaacagagaattgcaaatcaaaaaaaaaatgaaatatcactacacaattgctagaatggaaaaattctgaaacactggcaccagatgatggtgaggatatggagtaacaggaactttcattaattgctggtgggaatgtaaaatagtacagctactttggtaagactgtttggcaattattaaaacaaaactaaacatacctgtaccatatgatccaatagttatgctccttggtatttacccaaataagttgaaaacttaagtcccaataaaaacccatacatgaatatttatagtagttttgttcataattgctaaagcttggaacaaccaaaatgttcttcaataggtgaattgataaataaactattgtacattcatacaattgaatattatttagcactaaaagaaatgagaaatcaagccacaaaaagacaaggagaaacctcaaatgcatattattaagttaaagaatccaattattaaaggctatgtactgtatgattctaactatatgacattctggaaaggcaaaactatgaggacagtaaaaaaaatcagtggttgccaggagttggtcagagagagggataaacaggtggggcacagagaatttttaggacgagaaggtattctgtatgatactataagtggtgaatatgtatcacattatacttttgtcaaaactcatagcatgtacaataccaagagtgaactctaatataaactatggacactgagttacaataatgtatcaaagtagattcatccattgtagtaaatgtaccagtctggttgcagaagctgataatgggggaggctatgtatgtgtatagagcaaagggtatataggaactctctgtactttctgctcagttttgctgtgaacctaaaactgctctaaaaagtaaacatttcaaaaatgtgtctttaaagtaacaattacatgggcatttatgtgcatcattttcttagaggcaacaggaacatcaggaactagcttgatcaaactatactcatcttcaggacaagattggaatactgtccctaaattcccatgtggctgtactttatatttggccataataatttagtggtttagtatttgaaaatgtcaagaccagcaggatttacacaaatctaccactgctttctatcttctgctgcccaatcagaatgtaatcatcagttttacaactatttatttcaaatatgccctccgatatctctcaaaaatctaatcttcacatacgatatatttattaatttttcttaaaattctaggtagatcaaatctaatagttaaaaggaggcttgaaaattatctagttcctacatttttgcttaggaaaatgaagtctaagcaagtaagtgagatgttcaaggtcagacagtgatttaaaggcacaaatggaaacaaaatctgactcctaggccaggatactttgctgtgactgtctttaaatgatctcacaatctggaaattgaaaccacacatatgaacacagcattctaatctacaggtacctagggaactactagtaatagcaacatagatatataagcaagatgatgtgttttgttttgtttttttgagacagagttttgctcttgtcgcctaggctggagtgcaacggtgtgatctcggcttaccgcaacctctgcctcctgggctcaagcgattctcctgcctcagccttctgagtagctgggattataggcacctgccaccatgccaggctaattttttttatttttatttttagtagagatagggttttgctatgttggccaggctggtctcaaactcctgacttcaggtgatccacccacctcgcctcccaaaatgctgggattacaagcttgagccaccgagcccggccagtgatttgttttattttggttcatctctcatgtgaaactttatatcagatttgaatatttttgaaaaatatttagtgcaagtgagagcaagagggtgccagtcagacttttgtcactgaaaggccttccatgtaatcttttaaatgctagctgagtctataataacttttagagtgccctatattggctgatttttcttacacatacaaacactgttgtccattgactaaattgcatatttactagaaaattatattttcaactaattttcattttagtactgaggtttttttggttttaaaatgaacagcataacaaagcttttatagactgcaatagtaaattatcaacatgcactgttaataatatccagcaacaagaaaaatgttaccttttgaattatctttataataagtagagctgtttctcagacaaagatttaagaagtctctctttcccttatcgaaaacatgatgttgatggatgccattttcatatggaaagctattcttctgacaatcatgaaaagcacaactttcacatgtaggaacaaacaaaataatagagttgaaaaaatgattttaaaaagaaaattttaaaagtcccaagtcattaaaacaaatatagtaaaactttaatagggttatttacattaatttaatatttattttaaccttatgtgaacacattctcaactataagtaactaataacactgtggatttaagatgaataggtaactggaccaaatctaatttaactgcaaaatttcagttgaaagtttgttttccaaaatatattgaaataagtttgatttcttacagtttcttctaaaaagggagtgttctctttcaagctcattaaaatctgatgaaatcaaggctttactactagataaacatattatttgttcatcaacaagatatgagtttaaaagcagtatgtgatatttaggtttcaaagtttaataatgattactatctatatgcatagttacaatttaaataacattctttatgaactgaataatatatttagtaatacctgatatttatataagctctacagaataccattataaaacttctggattatattcaaccgaaaaggccctcttgtgtcactcgtgatctccaggagagagagaaaattaatgtagttctatgggcacctccaaaccaaagctgtaaaactactgccaaatcatgatcagtaactttctctgccttctctaacaccttacataggagtcaaagcaaagacatgtgataagatatataaaagaatccgattagagaacagaaatgctattcatttccttagagatagagtggtgcatataaacctcttatctgctgaacagaaagttgtctcccgccaaaaccccacttccaaaagcacatttgctgctagagagctggttctgtgtgtctaaacatgggatttttctgttcaggggaatcactcaggcccatagctattgcaaaatgtggacgggggcctaaactgatctgaatcaagaattggtagaggggatacttgacaggaattccactccactgtttacaaatcctgaagtttcaacagcagaaagtaactgttttaacattactaacagatacagttagatattatttttcatttggaaatgagaaaattctacaacgcaattacaaagtgaaccattatacttcatttgtttactttattatacgttaaaatctacctaggaagtaatctatagtacaggagctcttttagtctctcagcctaatcatttataaaactttttatttagggttcatagaaaactgaacaaaatccagagtatctttagagagaagaagaaagctcatatgaaacatatcaaagttgatcaaccatttcagaggataacaacccctaagttcagaagaatgtattaaataatccaaatattaggtaagagtacaaacctatcactatagacagttttctaattgctgaatgttattaaatatcagcaatattgtatacatatttaagcatgggttaagtaaaatatactctgacattaatgtcacatgttttttcacaccacatatttcacatttaaaaagacagatgattttgtgtgtgtgtcaggagggggctcaatatgcacacaaagttaattagaaaggttttaccttcgttgactgtctgcatcagctaatttaactttgtaaggcacaatattttctgcttcttcaaattcctcttcataagtcttattaaattaatgttatataatattagtaagttcataaaaatttattacacattaaccaacttacttatgggtgatatttggagtacatttttcctacaaatgatgttatgagagctctaattatattttataacacataagttctaggagaactaaacaaattcaactgacattggttgatatgtcaattactttatcactattataataccccaatccaacaataataacttatatttaagtatgtagctactacctgccaagtagattagtgactaggaagttgtcagttctctgactggctcatcataaacttacgctgtgtatcaacaatgtaatgaatggcatgcccacatgtatgtagtgtgtgtgtttttgtccagtctctcaaatttatccagaggagaaataaaaatgttgttagccaaaaaacacaaataacaaaaatagcagaagctttcaacctaaagaagaaaggaagaaagcagtatttaaaagaggtaagttctccattctagtcattttcttaacaaccacagtaagagaaatatctaggacaagtggcacattcagctactatattactagaaagtcagaaatgcactgagtgtatcacaccctaaaccttcagtccagagctctagctctgacagggtctggctctagttgatgctattggtgtcttctacatatgttcaagttatgttcaagttatttgactgaacttcttaagtcttacacactatttctacatttaaacggaaaataatattaaatgacattcaagaaactaaatttacacttatattttaataggtaccatgtaacgagactgatatttgtttaaaaacttgataacatagagaactaaactaataaaatatcaaactacatatctataagttaaaatagtgaaatgtcttcttacctcccataatatattcatccaaaaaaattgacaataccagtttagctcacaaatttactgtttacattcagaataatattgttttattcttataagcatatttaaacccaaacacttgtaaatttcctattaaactatgttagttatttgagaaatcttattgaaaataatatgcagatgtaagtatacattatgaattccctgttaaaaatcatgaatggtcattatgcacttatgcacttacatcatccagttcgactatctttagagatggttcaggtctctctatgtttaatgtttctactggcaataaaagagctgtgtgttgtactttggtctcctcacctaggaaataagattcacaaataatatcatcaaagaatatatcttactttataatttcttcaaataagatagccaccaaaaaagaagagtgttctcatgtgtatctacacaaaaatacaaatactgtcaattttcccagttcaagtgaaatacacatttattagcattcaatttttaaatgaaactatctaaatcaaggcaaagtatatctagggaaagggaaagaagtgagtgtacatgattttcatctaaagagaaaagattacatggtacaactgagaataatatattaaagaaaaccaaaagcagattctgattaatgcttagtgtatataacttgagacaatacattttaaaaatatctaatcaagtatgaactaaccatcactatcttcatcgttttcattttgagaacactgtgcatcaccagtggtttcatgtggatgtgggaacgtatctggtagcattttaaaaagttgctcttgtggagttctacaaaataagaaagaagcaattaagagactgaaatatattacctgaaactttcccagacaagctcttgatttatttatcaaatgaatgagtatacaaaattaatgatgaaaccgtaactgtacctttaattcaaagataagtacaattgtataacagaatcttaatgtactaaaaaaaaactgtgtaaatcaacttgacatcacagaagatttttaaattgcatatcctactgagttttgtttaagctaaaaatcaaagttatgctacaagtcagtgttctctcaaaagccacatggagtccattaaaaacaccatgctacttaaaaagctaatttatgaatgtgagttttagttcacagtcttggcattgtgttgatgagttctacgggaacctgagggcatttgtctaaatttccatcctaccagcagggtggtaacataggctcctacaataaaaatgtaaggtgttcaggctgtggtatctattacttaattaacaatgaagactgctgcagcccatttcatatggaaggcagtgaagcccaggaattcacagaggtcaagagtgtatatttggtttcatagtatataaccaaattattggagagaagggtcactttttaaccaagaatatgagtagctgcacagcctttccataccatgcaagttcataaagtccccatgtaaaagccagagccttctcagtgatatttgtagttaatatggatacaaaatctaaaatataccaggctccattctaactaattttggtacattaaattttattagatattaaataggcactagtatgatcttaactttacagaggatgagactgagacacaaagtggtgtaccgacttgttgagtcattcaggtagtgaatgcagaagaggaatttgaactcaaggagtctgcctcccaaaaaccatgttcttaaccacgtacttcctttgtaatgcctcttctgcaactttcaaaggcattaaaattttgataaaattgacaagtgactttggaattacatttatatgccaattgttaattagaaaaaggcaattaacagatacacactactgttacacatatcctcattcacttttaaaatttgaataaatttgtggtgtacagttttgtgggtttttaccaatgcataaagtcatatggaccacagtaccccccaaaaaaaatagcctgaagagctattatgggcatcatactttaaaaaatatatacagcctggacattagttataaatgaattaccttaaacctctgccatataagctactacaatgagatacaactacacgccttattaaaatgtcaaacaaaagaaaaaaaaactgaataccaagtgttggcagggatttggagcaaccagaactctcgtaccttgctggagcaaatgcaaaatggtacagtcaatttagaaaagagtttggcagtttcttataaaaataaacatgcacttaccatatagcccacctatcacagtcccaggtatttacccagggaattaaaaacctatattcaagaaaaacctgttatgaaaatatttttaaaggacctagtgataattgccaaaaactggaaaccagccagaacaaatattgattcatacaagaacatggatgaatcttaaatgcattctgctaaatgaaggacatgaaaggacggatactgtatgatttcatttatatgacctccaaaaaaaggcacatttgtaagggtggacaacagatgaatagttgttacggactaagaaagggaagagaagaaagaggaagctcaagggaatgtggttgtaagactgttttttgtgggggcaggggtactgtggtagacacatgactttatgcattgctaaaaacccatagaactgtacaccacaagtttattcaaattttaaaaatcagtgaggatatgggctgaacccaatgaaagtcataccaaccttaaaggaggtaagaaataaatgagcactatggccaaagtaatgttggaaaacatggtttggcctagataccgtaggctacagataaaagcatgacacacaaagactgtactctaggtggaaaatttgtttctttcagtgatattattaacagtaattttgaaattaattgtcccttgtttctctcagtgatatttgtgattctgaaactactgtatgtatacatacatatatattttagggctaattaataaatatattatagataatgaaagccaagtttctcactgtaagtgaaagaaatttgtcaaataagcaaagggagaatggaaatgaatcatgtgatgctggtttggattcggaatgcctgggtgtgaatgcatgttactttaatagatatccagatggatagatacagaaaaaaatttatatgtgtgtatgtggatttgtgtgtgtgtgtgtgcacgcacgtgtgtgtgtgtgtacttcccagtttcttcctctgagaaggcctagaattgtggcaccagaatagtaatgatcacacctagagtccagatctttgtttctgagcaccattctccaataaagggaaccagtattttttagaaaaacaattccttggcttgggcagggaaaatgcatcttgagttccagaaaaaaaagagatgttcaaagcaaactaaccaaaaaaaaaaaaaaaaattgatgacaacaaatcaaaaggatggaagagtcaacccgacagagtccacaatggccaaggcagaaataatttgagttgcaaaataaataacaataatattagatatcaatccccaaaataaaataaatattcatgagttgacataaagaaaaaataataaaagtgggtgaaggaacacttcttttaagaggaattccaactaataaatttagaaggaacaaaggaaatagaatatctgcaatagagcaggagagtactaactgctgcaggcaaaattcactcacaaactctaaaattaggaggtgaaagtttaagggaaaacagagttgatgtatcatctcaatgtgtctcctctaaaatatttatcaattataaagggaaagtagtgattttacagtggagaaacttagcaccaccttaactatgtgatcaaggttaacatcatctgtaataagatatattgacatcacgatcccagaatgtcacgcactgagaaagacacatactctctgtggcatttttcctcacagtgtataacctcagtctaattatgaaaaaacatcagacaagcccaaattgagcacattctatgaaacacctggcaagtactcttcaaaagtgttaaggtcatgaaaggcagggaaagactgaagaactgtaatggataaggaaatatgacaaaaaatacaatgtgtaatcctggactggatcctggaatggggtaaggataatagtgaaaatgctgatgataaaattaaggtaaaatgtacagttctcaataatattgtccctatgtaagtttcctggttttgatatgcactatgtttatgtaagatgttaccattagagaaagctgagtgaatgttatttgggaattctttgtgctattttgaaacccatctgtatatcttcttttcaaaataatccaaaagaaaaaaaatctagcacattacaaacagttgaaggtgagtggtggtgcgggtattaacctatctagcagaggcttcacgggaaacatgagggctgatttcaaaaatctgaagagataccatggagaagaaaaattagattttatctgtatgggcttaataggtagaattagaaccaagtttagaaattagctggaaacagattacagttcaatgaatatctcttccacagatggaatgggccacctcgggagatggttttgcgtaactgaaggtgaagcaagggtgtgatgaccacttctcaggcaaattctagagagctcctccaacaacttgcacctcaaaaaaagaccagagaccagcctcatccaaccattatcacctgggagctattagaaattcagaaatacagaatctcaggcctcacttcagatctacgaaaaaataacccatattttgccacagtttctagctgattgtatctggtgatatctctttgaataaagtatatttaattactattaataaaattagaaaaatgtttaattaatttaaaactagattctgaaaattatagtctcaaatgttagtgctaatataaaaaactggtgtcttctcaaagtaatatttcatttatcacattatttttattattcttcttaaattcatttctgcatttgcgccttttccttatatacacatttccatttctcaaggaaaactgtaaattaatgatgcatcatatacataaatagaattaaaattcttattggaacagcaacttcacagggatttaatcttgctttaaaattatgtatgcaaatatgaaatatacatataaaattgctataggaaggcatgtcatacaagaaagaaacataaataactttcatatttcctaatagtattataatttcagaaaatacctcctgtgttttttaagccataatttttccatataggatagaatgtcttctttaagttcaatattaagtggttctctccaaattttcagattagtctgtacttcgcattcttccaatgagtctgtaaaaataaacacaatgtgcataattaaaataagcaagtttacaaattactatatcttctcttaagatgtagaactcatcatttttggggcatatatgctttaatatttacttatacaatcaataggttaaggtttaaataatgcaaaagtattaaatattggtaatttattaagggactggatagacagttttcttcaacaatctcttgaaatgaagggatcttatgattcagaaggtttgttaaagcaactcattcttttaaataaaaattataaatacaaacattcattgtacattgtataaacacatacataaaggtataatacacagatgtataaagtgttatagccactgacaataatatttacacattatgagaaacaggaaataaataattcataatgacatctggaggagacaattttcttcacaaatttatatctacatggtaatttacttccagatgtttaagatatttctgaagcactactaaattaaaatcactattcagagatatttaaaactgatgaagatatctaggaaagaaagcagtgtaaatccatgattactagtctctccaccctcccacgtatcgttcctgtctccaaactgaacatcacaggggaaaaaaaatgtaggagaatcaagggaaatagtaaagatgggaaaaacatttttttataaactaaggctagagggtgtcccagcctcatattgtagacttcaatgattaactgccagaaacagctacgggccagcaatggaaacaaattaaagtaaaaataaagtaaggaatcccacttctatttttcccaaagagtagagcagtgttgaagaaagcaattggaaaaagtttgggaaaacactgatcagaatcccttgaactgaaagagcagagttaaggacatgagcaagtcatgagagagaagaaatgcctccactatgagtcccccttttcattttgaaacaagatttcttgacaggagagctaaaagaggggggggggggaaagaactcttttgtttttgctgtctagatgttagagaagagccactgtgcttgagatataaactctaaacacagaagggtgatggaagaggaagaagataaagcagctggcccgtgattcacttttctcccttaccaatggcacattcccaagaaataaagatgggaggtgacctgggttaatttgtttgtgaatatgttgataactggacctacaggcaaatgaattaataatatttgctgggaggagactctttagctatatggtgtatttaaaatgctagctcttgtttagaattgcttgtcgtaaacaaacttacggatttatgaggcatggctccctgggaaatgccaaataaggtatgtaacttatgtttttatttgctcccttctttcatggttcactggctacattgtataagaatgtgcataagattctccatcctcaaattgatgggatcatgggtgttttccttaatagatagtgcaaaagtcctgatgggaaagtatgcctaaagtatgtgaagaacgggtagaagtcaagagtggctgaaacgaaaccagccatgcctgcaggagagtaacaggagatgagatgtctgagataatggacttcagatcacacataactttctaggccattgaaagtacctgcctttcacatagaaggaaatgagattttagaatactaaaacaaaaccaagttaaaaatcaataacagaaataactagaaaactagaaatttaaagcatactattaagctgaatggtcaagaaatatgtgaaaagatgtttcatgtcatttgtaataagagatacacaaaatcatctctattaagcaaaaatttttaaatctcacaatattaaatgttagtgataatggaaagcaaacaaaattcttttttttttctttgtgataggctctcacattgtcacccagggtggagtgcagtggcatgatcatagctcactgtaactttgaaattctgagctcaggtaattgttgaccctcagcctcccacgtagctaggactataggttcacattatcatgtatgacttttctttaaattttgtgtagagatgaggtctcactacattgcccaggttggtcttaacctcctggcctcctaaagtgctgaagttacagacataagccagcagacccagtctctttcttaattaagggattccagagctgtgacctggcttaggtctgaggacttcataaaaaactgaatccccaatatggtggctgaagccggctctctgcccattaaacagaaattttcttctactataggtaaaacagtaggctgcatgactttttcattcctaggcacaccaattatcgtcagaaatctctgtgaattgaaacactgatcactactcctccttgacccttacttcggtaactttttcaccataattttgaagattgtgtgccaacacctggcctctatcatttccattctttgaaatcaggatgcttggtcccattgaagcattcccctccagtcatcttcagcctatagaggaaggccacaacaaacctttttaagtattacggtgcttaatgccttggtaatgacagctaaataggttgcacattatcggttccaaaattcctatctcccaaagccttccaacttcttcttctacaaaatggcagggaaattacagcatctcaatctcataaactttcaaatcaagtccagttttcaattaaccaacccgcccaattgttactgccattcctgaagtgcttgagacaaaacactaagatccaaatcctgtgcgagtacatctacattgataaaaacaatctcatctaatctgatttgttttttatttcttaatctaacactgttaaatgtcttcttctacttgctttccaaactcgtgtgatacagttgaaaagaggcagtgcctgctattttcacttggcatattaatctgttctcacgctgctaatgaagacatacccgagactgggtcatttataaaggaaagaggtttaattgattcatagttccacatggctggggaggcctcataatcatgacagaagacaaaggaagagcaaagagacttcttacatggtggtgggcaagagagagcttgtgcagggaactcccatttataaaaccatcatatcttgtgagacgtattcactatcacgagaacagcacaggaaagacccactcccatgattcaattacctctcgccggggccctcccacaacacgtggaaattatgggagctacaattcaagatgagattttgatggggacacagccaaaccataacacctggtatggacgtgggcattgcacttcttcatccaaattatactaatcatttgatttttttgacctccacttaggctgtaagttccagacgaagttgctactgcttttgcacatcatttgaccccaccacatagcgtgtactcaatattcgctgatagaattattattgagagtaatgttgtatacctctaatatgtaaaacattacttgtgcccaaatattagcaaataataaaaataaaaggtaatgacaaaaatagccaatattgtctacttcacaaataacagtaaaaagccagttataatgataataatttattgtcaaccaaactggctaaagttaaagaaccagaaaatgcaggaaaatagtcatgtcacactctaccagtgagagtacaaccaacacagtaatctttttggaggccagtttgacaatattcattaaaattttataaaacaagtcaccactgaggcaacatttctatatttagaaatttattttaaggtaaatatgtaagtgcacaaatagctaagatgcccatcataatatcttttaaatactgggaattagaaataaaatatccatcgataaatgtctgattaaatcatgccatatagaatactctacaagagttacaaatgattgtgtgtatctctatttagatggccagttgcccattacagaatctcagtgaaaatgcaagttaactaatagtatttagtgttacctcatttttttgtgtgagtatgtgtgtgtacataactatggttattgaaaaacatgtaccaaaatgttaacatggattttctctatatgatgagactgaggtattttcattttcttcttggtaactttttgttataaccaagtctttcaaaataagcattcattattttatcatacagttatttccattatgaagaacaaattttaaaagagttatacttctgatctggtgacttttcaacttggtacagtattattttaaatactatggcttccaaagcagacaaagaagaatttctatagaataattagtacttttcagagttgacaagtcaaaaaaaaaattgcatgaagtagcaagcataaagcacataaaataacacagccaatgagaaatgaggtgtatactgagatataaactactaagaagacagcatccaaataatgtcttgaaaatgtcaatgaaattgatgtgtgataaagaaatgtagaaaaatacttgaagaaaatttatttaaaagtttaattataattagaagacattgttgatactttgagattagaaattacactgtgtaataaaagtgtaatagtcagaagagtttctccaatggaaaaaaaatgaaataaaaatagtaaaattggcaagtaagatacatgattgaaatttattatctaacattttatattaaatgaaaagcaattggaagacactacaagattctgagtaataaaattaataaattgaatacttttaaaacttatggttttcctcaagacatactgggaaacttcaacatactgttcagtcatctggatcatcaatgtctagaatgtaggagcgaaattataaaaaaaaaaaaaagaacgaaaagtagttcaaaaagaaacaaaaacaatgagaacgcaaatcaattctcctcctgaagttcatagtggtccttaaaattgtatttttaagtcaaatattctaaaaaaaaaaaattcctctttatctcacagactctcccattttatgtgttacaattactgctcaaaaaagcaatagttgtcctggcaaaaatttctactagaagaagaactgaaagaatccaattatccattcatttgacagtctgaatttacacagaaaacaaatgcaaatccccctagtgcccaattcagggcctataaatattaaaccactcaccaatgatcacacagtgcatactcctttgaggagttatagcaaactgctgtcccagtgtttatagattttgaatatcacatttatattcacagagaatggaggtaaataaactaaagtcagcttcattttaaaacattcatggtataaaaaaccatacgggctgggcacagtggctcatgtctgtaatcccagcactttaggaggggaggcaggcaggtcaggaggccaggagtttgagaccagcctgcccaacatggcaaaaccccgtctctactaaaaatacaaaaattagccaggcatggtggcacgcacttgtaatcccagctactcagaaggctgaggcaggagaattacttgaacccggaaggtggaggttgcagtaagccaagatcacgccgctgcactccagcctgggcaacaaagtgagactctgtctcaaaaaaaaaaaaaaaaaaaaagccataccttttactgctgcatgtaaattctgtttcttgttgtcatcatgatttccggttctccattgacttaacacttcctgaaaggactgtgcagaagcttcttcatcgaatgacccttcacacaacagactctttcttggttttgtacgttgtgctcttttcatcgttgtaatttctacctaattaaaaggatacataggcatgctttattaaattttctgtatttacccacaaaaattgttttaataaaaaaattctgtgttttaaaatacaggtagaactaattattagtcatcacaaatcagactttttaaacttagaatatttttaagttgtgcttatttatatgctttactctgttatttaaaactctattggcaattataaatggtctcttcagaaatcatgaagatgacagcctacagaactaatgacttatcattatgctgttcaccagtgttctctctgtaaaggtgcaattgccttgtatccattctccctacgcctccaatctcctactccccgcaaccttctcatatcaaaaaaacagggtttttttttaatgtaaatctgatcagacattcccctgctcaaaactctctgttgactgtctatgaaaccccaagttcctaccaggacctacaccgccctacacaaccttgtatttccttgccttttactttacctccttccattctcctttcattcaccctgtaccagctagtctcacattcttgcagttctgagaacccatcaagcacattgcctcttcagggccttgtattagctatacccaatgcctggaatgagccttctccatatctttacatagccattccctcattttgttgactcaatgaaatgctcaaatatcacctactcagagagttcctcactaccaattctaaaactaataggccccctttcccccatttaataattccttaactgttttattcttcctcccattacttactcccatgtgactttattctatatgtttatttattgcctgtccttccccattagtatataatgaagttgtggattttgtcttttttcttagtgccaagacctgtgcctggcacaaagtaggtgttcattaaaagtcagtggaatgaatgaagaagttcatcgatgcatgtaatacaatgcatgctcctcagattaatgatggttgtggagagatgaattcagtacaaaatataaatccagtccaagcacacaagaaaatgaaggaagtatttggaagctatgcagtgaatcagagagaacagccacattaggaaacccaagcaaagtaaaacccacaccaatggctgaattatcaaatgtggattacctacactggtcaaattgctaaatatccatgtgtatcttttaagacatgagagtataaatctctatgttcagcccgcaattgaaaaataaacaggcagcttgttagagtacaattcagggtatattgttaaagacgtatataagaaattttaaatacgagcaaaaagtatctgaggacctgtcagacactagacaccatgctaaccgttggccacagaaacacaggttaataagtccacaacagaaaaaggtgcaagaagcaggtaaaactcaggggaaatgatgtctgaattggattttgaaagataaaacaagaattccataagcaaaaagtgccaaaggcagcattccagagaaaggaaatgatacgtatgctaggacatgggagtcaaacagcattggtggcatggaactataagcagtttgcattgatgtagcaaaaagtaaagaatgagaaaatataaagggtagaaaggaagcaggggaagaatatcaagggctctgcctgctgcacagaggagcttaaacccattggacatgtaaaaccattgtaaagtcccatataccagtgtggcaaagagagggaaattataaaatagtgtgtttggctgcaaggaaaccaattaaaatgttacagacatttgcccacattgatcaacattacaaatgcataattttttatctaggagtttcaggattttatcatactgatatacttacatttgtgcaaaaccacattattcaaaattatactttatattttagcatatactggcaaaagactgaaatagcataaatgctgatcagtggaagatagatttttaaaagtcttttcacatccaataaatggagtattttacagccactacatagaatgagaaggttgtaggatgtacttatgtgaatataaaaactacaaagttaagtgaaaaaaaatgcagagcaaacatgtttgtagagaaaacatattaacgtttgtgtaaaaaatacatacaaaaccagaagggttgcctgactcctagaagagaatgaaatgcactttccatttataaacctttttttaaagaagaaatttcagtatctaaaagagcaataaggatagaataaatgaccaaacattcaagagtttttagctgggagcctatatgggacatgataactattgtggactgaattgcatcaccgtgcacaaattcatatgttgaagccctaacccccaatgtgactacattttgagatagggcctataaggaggtaattgaggttaaatgagattatgaagttgaggccttaatctaataggattggtatcctgttaagaagagggagatagttggacgtggtggtatgcacttgtggtcccagttacacaggaggctgtggtggaaggaatgtttgagcatgggaggaggttgcagtgagctgagttcacaccactgcattctagtctgtgcaacagagcaagactctgtctcacatgaagaagaagaaaagaagaaaaggagaagaagaaagaagaagaagaagaaggaggaggagaagcagaagcagaagtagaagaggaagaggaggaggaggaggaggaggaggaggagaagaagaagaagaagaagaagaagaagaagaagaagaggcatcatatatctcttctctctcctctctttctttctctctctctctctctctcccccactccccttctgtatgcatgtgcatacagaagaaaggccacataagaacacagcaagaaggcagccatctaaaagccaggaagtaaagcctcaccaggaaccaatactgccagcacctttatctgggacttctagactacagaacagtagaaaataaatttctcttgtttaaaccgctcagttggaggtattttgttatggcagcctgagaaggctaataaaggtaaccaactgaatgtgcagaggaggaagtgaaaatactacagaaaataactgcctttgttggcttggaaagctaggtagggcgcctccaacaataacatttataggttttggaaaagacaggataaatttagtttaaagatagagtcttaggagtatttgtgagaaggtacttattggtatccagtaagcaatatgtcagtgtatgtatgtatacatgctacactaatgaacaagcattgaaaactcagtggcttaatacaaaatgatttcaacatgcagcaatttcagcagccctccagggaagcttccttccaagcaatgaatcagagatgtcagacattttcatattggagttatgccattggaatacctggcttccacatagctgtggcagggtagaaaaagctggagggttgtacattagctcttaaacgtttcagctcaaaactgtcatatatcacgtccactcagagtccaatatgaccttgcccaatgctaaaagaaatttgaagacgcacatagaaattcaatgctgtacattcattaccctgtaagcacatgatatccctgtaagatgatgtgttttaatatccccactttccaaaggagaaaacagaagagcaaaaaagctaagtaacttgcccaatattacaatgctataagaaaaacagcatcactatttcaaacccaggtttcggcttataagatgtaagctctttcgtgaactgtacctctttccaaggatgtgccattggctttgatccattaaaaaggccataagagaagcatcaggcattggtaccatttggctcttctagccattaaattaaaaataagactcttgagccctaacccagatgtaaatatttttaaaaatccaaatttggtggcagacccaggaatgcaagtttttaacaatctccaattcttatgatgcttattacagttggaggagcactgctctttggcacagaggaacactaagcctatgaagcggttatctcttcattgtgtactctgtcgtatatagcagtgactcccaacaagaacactcaccagaatcactgaggagttaaacacacacacacacacacaaacacacacacacacacgtctgaaccccacccacggagatgctgaactcaatcatatgtatttctttaatgtttctctagttgattttaatatacactcctggatgaaatcattgaattaatggtttttaagttaagacaatgaggcagacaatgtatacagcatgcatagttacctatgaagaccagaagaaacatctagtgtaaagattaataaataacacagaggagcctactctatcactttctagtaaggctagttactgaatctctcatctttctcatctgttaaattggggtaataaaagcacaaaccttacatggttattgagattattggataaggcaagtaaagcattaagcacaatgcctagcataaggtgttcaataaaagttagttgctgatttatttttgataggattaattagatgaaaagggaggcacgaagaagaaacttttaaaaccacagtctctgcaaaatagttaaatgcaggaaatttggagtcagaaggtctgagctgaaatctaagttccattatcaattctacctttggcaatttataaaaactattccctgccactattctctcatttgaaaaagaggaataattaagaaaagacaaaaggagataatgtgtaaaatatttagggcagtgtctggtcttcaatacattattattataattaggaggcagtgattcttcacaaaacatccttgacaggtctattagaaagcgaaatccacacaaatatgctgacactcctgaaaaattcaagcacactccctctgctgaaaataggtcctactagcatagaacacattttcttttatgtctatgagcatgggtttggaacgcaacagatttaacttcaacccagacttggtcaaaatataacaagcagaatgacttcagctaagttacagtttttgaactgcagggaaaaggtgactggcatctaaaagaatgaggattataacatagatcaaaatttgaagttcatttcttgctaaagaatcaatatgtctattataaatatatagacatgagttgataaaagcttatctagcatgttgtcagatcagcagtcaatctaaataactgccagaatttggtataaatctggttttatataactgtgcaattgcctgtcacttaaaactctgggcaaggttttgtatttttagcttctctgaatgaagtcctgactaatataaaattgttatattgcattgtggtttttaaaaaaatgttttccccaaatactcatccaattcctgacatggatgaaaatgtccagaaagacatatggtcaaaagatcattcaccaaaaagagtagtgttcagtggaatcaaagcaggcttcttgaaaatatttttatagtcaagatgtatttggttaatgaagaacaaatccatatgaaataaaaatgtgatgaaattattggtgaaattctatagctcaagttaagtacatgaatggcacctgccatagttacatatgtcagaaaatgtctactatattttcctcagtttacctcagagctgctcctctggagaagtacagatttgggtttatgttgaattttactggtttcctttgtagaattattctcctctttgggttcatctggattaacatcctttataaactgatgggcaacatccaatacattgaataatatttgagattttgcctattaaaaaagtaacaatataattaaagcgcctcatatgttaacctaaataatttatatacattaactcatatttgtgttattctatgactcccagaattaaataaattcaatttaatatttaaaaagacaaattggcatttgtatcaacaagtataatagtgacagctgccatctactgagggaactagtttggcctcatacaattcaaaccatcttaaaaacaatatatcacttaatcatcaaggcaattctaaaacataaatatttttatctgttttaggaattaagaaaactaaagcttaggccgggcgtggtggctcgctcctgtaatctcagcaccttgggaggctgaggctggcagatcatttggaggtcaggagttccaggacagcctggccaacatggtgaaaccacatctctactaaaaacacagtaattagccaggcatggtggtgtgtgcctgtagtctccgctactcgggaggctgagacaggaggattgcttgaacccaggaggcggaggttgcagcaagctgagatcaagccactgcactccagccttggcgacagagcaacactccatctcgaaaaaagaaaaaagaaagaaaagaaactaaagctcggagagtttaaacaacttgcccttggtcacagtgctgagtgggtgccagagttaggaagtgacctcaggtgtgtataagtctaatgactcataaactttccactatgcacacccccaaatagatagatgcgatattttgtgcacatcataaataaagaactaaatatagctaatctagtaggagactgaataagcagtaatgactactccatggtgataaaacgtctttagaaagccttcactatccaaaggggtacatcaggaagcacttctctctgtagttccttaataaactccaagtcatttctcattttgttccttgctcatgaggctcacttactagggaggctttctctcctctaccatcatctttacctggcaggcttttgcttctcctctgcattcacgccattactccaacaagtctaggaacccttccttgcacactgcactaccccaactgtacacggtatttaccctctttaccctcttaatatcctgcgtagatctctaccagccctaactatattgatttcacatttcctcatatcacataagctcacaaaaggaaaaaacatatatattttaatgattttatggctactacagtttctggaaaaatagcatacggtaaaaataaggtgtcagggaaggaaaagagctacagaattaaaataagtaatttagaaaagggatttaaagaaaaacttttcacatgctgtcagagtgactgacaaagaactggcaaatttggggaaggccccattctctgaagggttttctatcagaaactaccagagtctgcctagggactgcaggatttaggatcctatctgagtttgaattaaactccaggggtaagattcagaatcgtcagatgctctgtgagaacttggcatgaggaagacaggaagtagctcttatttcttagcaaatatcctccaaacaagaaaaatttagcagggatcagataaaattattttgtactctgccatgaaaatgctcctatttttaaattttcatctagttgccaatttagatagctaacattacattgaaactttttcagttatgacatttgtaaatctattaagattcattgcagtctgattctggaatatatcagtgaacatcaaattaactagtgttatttcatactgaattaataaaatacctatgaaaaatgatgaacgtgacctatgcatatatattgctgtctgtatgcaaatctgtggaatctgctccaaattttcccaatgattctcagaaaacctatataggcctatatagtccttttatttttaaaagaaattcaagtcaatggtaatgcttcactctttcagaaacatctgtagttttaccaacatttttaaaacagaataatccaaactaagcctcatttaaaatgtcctagaataaaggtctgtagatttcagaggcagttagttccatgtttggttttcattttattttttttaaaatatcaaaagctataggattaattttatataaaattatcattcaaatatatgtttatttaagtaacacaaaacaaagattatttctgtcctaaaatgaatcctgctatcaatgttataataattgttataacatttttaggtagcatattaagagaatcagaaatagtgaaaaacccacattttttatgctaaaaaataagataaacatcataggtaactgataaaatagaattccatatttgactatcttaaagttctgctactttagtacataaatgaaatcaatacaatgcaaataaatggaaatgttcttttctagaacatcatactcttaaacattacttttctccattgtaaggctgtgtatgtataccttacttttcttaatcttagaacaatcatacaaagaaagagagcagatattatgattcccattacatagacaaggaatttcaagttcagaaagcttaggccaaagtcaaatggctacaaaatgtcgtgacttgaaatagagtcaaattatctattctagcttaattaacctttttccctactagatttatgttagtctttgtgatacagaaaatgtgttttacctttgatttcccgaaactgaaaatattaaattttgtctctaacagatttgaacattgttctttgctttaaaaactcacaaaactttaattctgtattcaattgcatatgcaaggattaaggggtttagttttgtttgtttctttgcttttaacttatttttgcctgtttatttttatatttgaccaagtatatagaaataaatcatagtcataccatataaaaaatttaaggaatggaggttcctcctattttcaagcatactttctctgctgaaaataggtcctactagcacagagtacgttttattctatatctatgagtatgggtttggaactcaacagacttaatttcaacccagacttggtcaccacataacaagctgtgtgacttcggctaacttacagtttttgaactgcagggaaaaggtgagtggtatctaaaagaatgaggattataacatagattaaaattcgaagttcatttattgccaaagaatcaatataactatagtttaattatattaacatgagctgataaaagcttatttaggctgggcagggtggctcatgcctgtaattcgaacactttgtgaggccgaggtgggaggatcacttgaggttaggagttcaagaccaacctggctaaaattgtgaacccctatccctactaaaaatacaaaaaattagctgaacctggtgttgcatgcctgtagtctcagctattcgggaggatgaggcaggagagtcgcttgaactggggtggcagaggttgcagtgagccgagattgtgccactgcactccatcctgggtgacagagtgagactccatctcagaaaaaaaaagtttatctaggacattgtcacactcagatcagtagtcaatctaaataactgcccgtatttggtacaaatctggtttatagcaaaatagtactccccagagtaactactgttaacagtttttatcctataacctttgtcttttcttaaatgggcatatcgtataatctttgtcttttcttaaaagagcatatctagatttacaaaagaaaacacactgcctttcacttaataatataacaataatcattttgagtaacaacaatgaataagaatatgaaggttatttttagaaaatatttaaaatagataactatacatattaagtatcataacactgtaccatatattaataaaatattttcaaatgttaaaactcaacctaaagatagttttatttccattttctaagtataaaaatttaaatgtgaagtattaataggtaacaataggagcaggaggagactgaaaatgtataaaattacctgtgcaactgctctacatgctaaaaatgttttaaaatcaaaccaaaacagccttcaaggcacatagtaaatcatatatctcactctaggatagaaactaaactagagccaaaagatgtgatttactgccagcatttccagattcccccacatccttcactacactgtataatggtaggatttcatctggtaactgttctaaattctcacctaaactttttttctgcctagaatgatattatctttcaaattacactctagaagaattcatcactctgacaatgtatcattaatcaaagtaaagagggttgatattttatagcattttggaatggatggcaccttgtagaagttaaagcccaagaataaaagttttagtttagttagaaaaatgatatactttatggtatagtcagtgcttcaaaattctaactaccatcatcatccaaaactctggctatccagcaataaatattaataatcatgttgacatagccatatctccttaagtgatccagaagttccagatcaaaaaaaaaaaagttcacacatagtttagacctgtattactttgcaagtttgagggggaaaggaatgagaatgtctcctttcctagtgttaacttgcattgatttttcagtcacaaaattttagaagagatttattgtaaccacagccttgaattaaaaactgaaaactctaaactctgcagaagagttctgttattttatttgagtttgttagacaaagtgatatagaggtagagagagagatacacacatatacacacagagagaaaaaattgtgttatagcagaactcaagtaacataaacttattggttgcagtgattgttcgatatgattggaacttggaaggctttatttacaaaatcatttcaggatgatcaagttatggactaatgggaattttaaaattgttatatatattctataaatctttttttggcctggcttttgagaaaacacttccttctcatatcaagaatatttcaaagtacaatctgttctgatttctttgatgtgaattacctcatatgcagtcggtaaatagggcaatgatgtctgtattaactccagagtgttattgattcttaaggtttttttcccaacgtgttattgttttgaagcaatcaggggcaagctttcttacaactaaagccaaaatcttaacaacatatgaaaaccataagaaaaaaacctgaaaaatatataaaaatgcctccccttagcttaagttctgactgttttagggacttcaacaaccctgcatttcactaagttaagccatctagaaaaactatgagcacaaagaagctgtaaagacacctcctctgactttaaagcaacagataaataaaggaggctatatcttgatttagatttttcattttggtaaaaataatctctcttagaagtgaattactactgggaactacatcaccaagaagtaagaacaagtcctcaagaagtatgcattagtgttttaactaggatttgttaactgtttttgtttgggttttggttacaaagcaccataggatttgagtggccttctcctagccctaatcttccctcaagccctgttaattaggtgggcaattttccaaatgagaaatggtttgtttgttttgtttttattttaagttccaggatacatgtgcagaatgtacaggtttgttacataggtgtacgtgtgccatggtggtttgctgcacctctcaacccatcatctaggttttaagccctgcatgcattaggtatttgtcctaatgttctccctctccttgcctctcacgcgtcgaaaggctccggtgtgtgttgtttcattccctgtgtccatgtgttctcattgttcaactcccacttatgagtgagagttgattggttttctgttcctgtgttagtttgctgagaatgatggtttccggcttcttccatcaagaatcatataccgtgttgtggcagcaacacatgtatactgaagaattatgctttaatttatggtaaaacaaactcttttattagaagtcatcaaaacatttgctaaagtttatttatccaaagaaacctgtacagattattttgccaggatatttctatttacacattacatggaatacattgcactatgagtatgaggatcctattatctaaaattgataataacaaattagactaaatctctctaagtttggagctataaggaaattactacaccaagtagataaattattcatattatcatagacctaactacatcaagcaggtactagttacaccaagcaaataaattcctcaaagtatcatagacctatggcaggatgcaataaacccatcaaatttccacttagtaaaaatatctttgcaaaataaaagtaattttcatataaaaaatacataattttgaacatcttaatccattaaacaagaatgaaaaaggtgagcattatctctcaatttttttacattattaaaatatgttttatattcttaaagcaaactattattttacctttcttatgggtccttctttatagatagtcttagaccaaatttattccctgaaaataggctttatcatagtcaagtctgaattctcgctgaaaattaaaggaagctatccataaatgattggatcaaagttttcatctactgttagaatcaaaagaaagggttggggggtgcaggggagtaaactttgggccaactggaaaaggtagagaagcaaagggaagaaatttgtatatagaagacaactggaaaagaaaaaaaaatttgaggaaaagcccccatctaaatacatagagaaacaggaggaaaataaatatttattagatgaaataaaattgcaatggaagaactaacagcagaatcatgttcttaaatcctgttctgctcatcatatttctaaaaacagatatggtatttgcaagagtagtggtacagaaatatcaagggtataaaaaactacttattgcaagctagatagaaatcaaatcctgcaaatgtgaaattcatgtggctgaaatttattgcttattccaacatcatgtaagtattactttaagtagttcttaaaagactgttagattaacctttcctctaaaggtctgatttctatctggttttattaattaaagatttatgtattattattcctccttgacccatagagtggcaaaaaaagcaaagacctggacacatgctcctgcttatgaatgcaccttattatttaatagatagattaaataaaactggactcaatatatagtactttataaaataacatgaaatctggactcagtttggactcaatatttagtactttataaaataacacgaaaataatgaaataaaacacatcaaatccagttaaaatattttaaaataagacaacatataaatggaatagctgaaaaagtaacatattgtcaaaaaagtttaaagcacctggtctcaggaaacataacaacattggattttggttaaataactgtgcctttcaattttcattacactacaaaattctacttagaaagcaatctcaaaagtgagacagaatagcaaaaacaaaataacataagaaactcacacctgtaattttgctttctatttgcagttttgatgccatataattatgcactatattaattatcttagcaagtacttgcaatttttttcaactaatattacaagtatgttgcatccagatgagttaactgctttcagcaattgttcatatttgagctacacaaggaagaaattgtatatgcaatgaaatggataacatttttaggcataacagaataaacttactaacaaatagcaacaaaatttgtcatatttggtttttaaatatagtattgctgttacatcacaattagataattcgtatcccataaagaccaatgaacataacgtatattacagcaagcaaaactactgtaaaatttgtcagattccatgaaaaaaatcatgagctcatttgagctacataaggaagaaatttcatatgaaatgaaatgaataacatctttaggtatagaagaataaacttactaacaagtagcaatcaataatttgttacatttggtttttaaatatagtattgctgttatatgacaattagataattggtatcccataaagaccaatgaacataacatatagcaaacaaactactgtaaaaatttgtcaggttccatgaaagaaatcatgagataacataggtagcacctgcaaattacaaaagtccctcaaatattctgcatcaacatgattgactaaaggttcagacagtgggttagactaatgatctttatggtcccctccaaaattgagattctattatcctctatgtgtgaataaattggaagactgtatttttatatatactctgataaattgagctctaaaacttttactgtatgggtttttaaaatacaaaaccattccaaaatatgtgtaaccataatgcttttaaaaaaacacccctacatgcatccatctgtattattaaccgtaggtaccatgttgtacaacaggtacccagaactcatttatattgctaactttaactttctacccattgaacaatatctattttccctatccactaactaccactattctaatttctgcttctataaatttgactgtttaaaatatctcatataagcagagttatgtagtatttgtccttctgtaacttacttatttcaattatcataatatctttctggtccatggtaagtgttattaccacaaaaaaaaaaaaacaacaagggacacaggaaacttttggaggtgatggatggatgtattaccattattctggtgatgatataatgggtatatgtacatgtccaaatccatcaaattgtgtacattaaagatgtgcagtttttatctaccaattatacctcaatagagctgtaataaaaaagaaaacagccctcaacacaaaattaatctttttgttaatcctttggactcatcattaatattacattgttttctgggctttaaatgtagataatataggaatgggattgaatttctactaatactgtatcctgactgataaaacctaatggatggagcaccttctatgagcagaatatttttataattgttggcatttaatgtgattttcacaatagccctgcaagcttctgagcttgcatatataaatatgatctttcaaaatttcctcagcataaacatcacagaaatactcacctctccctttaaggttgattcatgccatctctgggttaagcccctgtactgccactaccctctctactgtgtcagttgctctgtcatttgctgctgtaatatactcactaagccacttacattctcccaactcttcattaactctaatttccattctccctacccctttcaattgtctttatttccccttccctagcttttcttagaactggcatctaaaagtaattagcacagatataacttcactaaagtgcaggctactgaactgtcccacatccaggtcttcgaaaaattcttgtcaaaatttatcccaggaagatatacaaatggccaccaagcacatgaaaagatgtttgacatcattagtcatcaaaatgcaaaccaaaccacgatgtgctactgcttcatattactaggatgttagaccaaaaagtcagataataacaagtggtggctaggaggtagagaaatcagaactcttgtacatggctgattggaatgcaatatactgcagccactttgaaaaacagtcttgcagttcctcaaacaattaaaaatggagttaccatatgacccagcaattccaccagtaggtatctagccaagataactaaaaacatatggccacaaaaaacttgtacacaaatgttcatggcagcattacttataatagccaaaaggtggaaacaacccgaatatccatcaaatgatgaatgaataaacaaaatatgctatatcaaacaatgaaatgttattcaaccttaaaaataaatgaaatgctgatagatggcacaacatggatgaacattgaaaacgttatgcaagtaaaagaagccactcataaaaggccacatatgacatgattctatttatatgaaatgtccagaataggctaatctagagagagagaaaggagtattggtcccgagaatatagggagataggaggaggatggagcaaaagggtatggggtttctttttgaggtgacaaaaatgttctaaagtcaattatgctaatagtttcacttagcagtaaccatactaaaattcattgaattgtgcacttcaaatgaatgaattgtgtggtatatgaattatatcgcaataatgctgttcttaaaaactttttgtcaatgattcctggacaagtgtttttcatttgtcttttggctatcccaacattctatgtttcaaattctgactcatcaaggacttaaatgccatgctcaccagagtctgcctgtgttaactaaacctttaaaatctcaagactgctatcaaatcctcttggcatcagtctattcagaaggatgaggacaggaataacagtttgccagcaggacagcatcagctgttcctttttggtggtattcttgcaggagttcaagcagaagtacagttcaggtagataaggaatacacctgatttagaaaccttactttccaccagagccaatccccacctcatagctccagagctagttccatagtggaatgtttcagttacaaagcccactgcactcagggagctatatcttccttcaagtatgtatagttctccttgtttagatgtaatttgccaagtagaggttacacttaccataagtatgttgcctaggaatgtagttgacatgactacctttatctgtttcccagggaaagggcgagaaagttaattaaaggtcaaatgctcacatttaggaggaaaagcttttgttaacccttcactgatataacaacttaacataccataaatccttttaattatccaatccttggttaaaaattcccttgctttcaaaattcagagaaaaataaattttgccctaaaatacagttttacgctatttcaggagcttaatcaaaccactaaggactcattcacatttctatttgttaaaaaattgatttatacagcacaggtacaatgttaagcactgaggatacagtgatgaacaagacaaaaaagagtccttctcacaaggtcctaaaatttatcagaagatatgatagtcgatagcaacatggtttttaaaatcttttgatagaagaaatgccaggtgataacaatcattgaagggaatgaacatgcacttgtagtataaggaatatgcattattcatatttaagaaataagttaaaaatatgacaatactcaattgttcacatacatttaaaatattttatttttcttaagtataacattaatacttacaaatagaaaattcatacattttttcaaaatatttacatacctggactctaaaatcatgtgactttatgataattccttttttgggagaacatttacttgtcatccacatatttcaatcttattggtaactctgagagaaggaactgcgtttctcaactctgccccttctgtggtctcccatcaagctaccattattgactttcttcacataactagaaaaaactactttaaatttcatatggaaccaagaaagagcccatataaccaagacaatcctaagcaaaaagaacaaagctggaggcatcacgctacctgacttcaagctacactacaaggctacagtaaccaaaactgcatggaaattctacctcaattatcttttctttcattaataccacccaccttcccaaggtttctccttttcagttaagaaaatttccattccaattaagaaaatgtatttaccataatctattaataatttacttaaactaaccccccttgtgcatgtcatacttcacaaatagaatgctttttgtttgttttccctcatcttctattctctctaattaacattgtctcttctgtctgatcttacgttgctaaaaggaaataggaatgcctgatatattaagacctcatttctcatctgaaaataacttttgtttcaacccttagtgttgacaatctttctacatgtagaagtaaaattttaatccttaataattgcctctcatgcatttatgcctcatttttcagttaattaaatatttaacagaggttggaaaaggcaaagaaacttgaagtgttttgaatcactgccaagtacaaatcaatcataaatcaaaggaaaggccctttgaaattacaacactagtcaacatgtaaatatttgccttcaatttttcagagatcgtaagtaaaacaaggtatgctgatacaaaatgatccatactgactaaactcacaggacctactgggctgttggataaaggctgaaacagtttacaactatcaaatttggctacactttatattaaccacaaatgacagcacaggttaaagaatataaagtgtaatcaccgtcagcctagaatacttgctttttatatagcaatgcttaatattcatctgtcggatgtcttccctaacttctcaaattaggaatggattcagcagtcaacaaagccttatgactttaatggttaacaataaaaaacaaaaaccactacaagattggttagtgagagctaagaaaaagagatatctgaccaaatggccatcaaagccaaagcacaacaacaacaacaaaaactttatgcataggaaaatgataaaaacaataagacaaaaaagcatgttgactgaaaaaagaagtgaaaggttaaacagagactagagatagaaagaaaatggcagagagctacaagacaattgattaaaatcaagaaatgatgacagagaatgggcaagaccagaataaaggagaaaaattaagtactaatcagaatagtgaatttctgagggggaatatatcatcataaacactatatcagctatttgaggcctctttcttattctatttcttataataaaggtggttattataacaggcatgagtcactcacacatagtgaaactgttcactgtgctctatttacaggagggagtacgtagtacaatttgaaatagtttctttcaaaaaacatctatctaatttatttattattgtatatatttaaagtatacaaacatgtacatgatgttttggtatgcatgtacatgcacatgacatacatatacatgtaaaatgataactaccattgagcatattaacatatccatcacctcacacagttgcttctttttagtactaaaagcacctatgtataaaaaatggaatattattcagcctttaaaaagaagatatgtttaactatgacagcatagataaacctggaggacattacagtaaatgaaataagccagacacagaaagaaaaatactacatgaaaccacatacatgcagaatccaaattttttttaaaaacttttcatttaaaatttttgttttatgaataaagggacaaattcgctttaagaattagctgaacaaaaaagctgtctccttcaaagtactttattccttagtaattccgttaggtgaaataatgttataaaaaagagaataacatcattataggtttagctcccagcacaggaagtctgtgtatgctctttgctaagtgccaacctcacaattccacttccctagtagacaatacacttcctaggactctccccaacagcagcaccaagtagcaactttggtctccacagatggtgtggaaacataaaggagtaacatgaacaaggaagagacatagttctttattgtatttaactttaaatttatatacataaaagaatcccaatatttgaagaaacctttaaaagaatcatagttccttgccaagctctttgatttgtgtacatattatgtaatccatgtatgctaacttttagagataaatgtatattctacaatgagatttattaggaacttaaataccattttactatttgtggcttaccaaccttccctcctctgcaatcaaaaccaaagaatgtgatgctggcagtatcttaagtgttcttaccatgaaagaaggaaagagagaaagagagaaaaagaaggaaagatgaaagaaggaaggaaggaaggaagcaagggagggaggagggaaggaagggagggagggagggtggaagggaaggaaggaaggaaggaaggaaggaaggaaagaagaaagagagaaagaaagagaaagaaagaaagaaagaaagaaagaaagaaagaaagaaagaaagaaagaaagaaaaaaaagaaaagaaaagaagaaggagggagggagaggagagagagaaagagaagagggagagagaaagagagagaaggagagaaagaggaaagaaagaaagagagagaaggaaagaaagagaggaaattgtgatgtaatgtgaagtgatagaaacattcattatgttgaatttggagactatttcaaaatgtgtatctatatatatgtcaaaacatcaaattatgcaccttaattgtacacattttttatttgtcaattatggctcaataaagatagaaagggagtagagagagtctgtagattgccatacatgttctgtgcaaaagaactatgtaacccgaaggaagttatacaaaagaaacagtaaacatactatatatatatgaagtgtatattcggtagatattttctcactaatttaatccaatctacatttggaattttacaaatttccaacctacaatgatcactttcttctgttaagatacaggatacatacactttaataatattaacaaaacaaaataatgctcaacgtttagaaagcatactgtatgccatgttgctttcagtaattatttgactggtgtcgtatctgcatctggatcacaataagccatatcacagcaaagtctatcttttgaaattatgtgggagggagaggagaagacagggagggagagagagcaagaagaagaaaatcaaatttggataaatcttgaagctcagatactgaagaaatggagccatgtctcattgttctttgtatctcctacaacagctagcacagggcttaacgtcactgagtgataactcagaaaatgtgctcaataaatcattgaatgaaaaattcctaatatgaactcatctgtgataattttgttacagtatttatctacaaagtagaatgccttttgttaaattctatattattcatatattaacaattagactcacttctgtatcaattaattttcatttcttatgactatctgattgtaataccatgagagagagaagtagcaggttggtttttgtttttttctccctgcatcctttctgcccagaagcgctaaacattgagtggtcactcaaaagtcactgactttggtgaatattagttaggtatattttacattttgtggttatcattatttgggtcatcagcacccttgatggctactgatatttattagcatgttcaggtaaacgcaaagattgaaatctaccagtaatctttctaaacacagatctgattatctctattcctttgcctacagataatattaaaacccttaactaattaggagtaggatcctaccattattcatctctataaggtcacagcctagcacataccctgccttctagaaagtactcaataaatatttgttgaataaattactataaaatgaataaaatctatgacaaagcaatgcatcattaactgtaactagtgtaatgccatgtctatatctaattctatttatagtttaagtattagaatcttaaagccacttgacagggtttgagtttaggcatttccaaaatcaatgattatataaggataaacaaaaggtccttatatgtacagaaggaaaaatagaaacctgagagataagcgttcctaaataataatgggcaaagataaataagaactaatttttaaataaacttgaaaacataagagatttatacctaaaaactatagaaataatatttaaaataacctatgtgttcatttgaaatcacaatagataaaatattttctaatttttaagtgtcaagttcacagtcagaatacataatctgaagactctaagctgtttctgcaactacgttaaaacagtttaaatagtaaaatagagtctagattagtattcaataaaataatttaaaaatatgcatcaggattgtctgtatataatagaattttagaaattagcgtaaatcatcctgagttctagataactaaagacattttaaatgtctttatgtggaaacattttataaacacactacaagtaaatcattttagaaagccatacctgcaaaagagttgttctgtggagctttagtgcccctttctggtgaactttagcaaagcatcctgaacaataatcttctccacattcaaggcatacctaaaaagatattttttaaaaaattatacaatcttataaaatagtatgatttttagaaagtgtttgcataaagatgtcttgttttttaatatttatttctctaattaaatacctatatcatcagaattgagaagcctgtcccaggcttctcaactagtcccttaactgggactagttgtcccagttaagacttaactctttgaagaaaactaattcgaaaacactaattattctcatatcaaaataaatgtagttttaatgtaggtttggggtgtatattttagatgcatggatgtatgcatagtttctgaataaactataaaacaaccagtagcctcaggtcaaacttcttgacctggtaaaaactaaacagcattatctctgggtgaaaactccttcatttgtatgagttattttatctttctgtatggatttacatgacataattagtttcaagtgatatgcatactctttgccctccaaaatccctatacacttccctggaaggtactcctttactggtggttctcaaagtatggctttaaaatttttcttacaagcatctctaaaggaaaaaaaaaagtataagaaaaaaatactagatggaactacattaccatgtctgtaatgttaataactgataaaatgattatgggcaagtttatatttaacttccaaattatgatgtttaaaaatgtaattttaaaattgttggacaagttaaataatgtaaaatactcgtacctatgatggtgccaagcaaaactgaaactaaagagaaaaggaaatggaaattggatgtcaggttcaagatggatgattaaatgcagcttgggtgtgcctttctatagacaggagccaaagtatcaagtagatattcacatttcaaatagattgcctgagagagaacactggaattcagaagagagatgatgggagacaccaagggtgaagaaaagagaaacagggcttcctgcttggggtcactgggacctggacccagggaaggagtaagtgaaggatttccaatgctcctcattcctaccatggacctctgcaatcctaactatggagagatctaggagccccataggcctccacactggcctagagaggtgcctggatatcacacagaggaatggctagaattcatgtgaagtcccataggcttccaagtgctgagcagctgcactaaggtgccattcctggagcccataccccaagggtctgagtcctgcccagagaccactggtgcccttcctgtctgcagggctggggagcaagaggggaagctgggtgttctcatgctctgccactactgatgcatgacctggtgcattcagatcaagcaccccattcctgtcagtctctcccaaaactgtctgctggcctttccattagagaatgttctgcccttcctggttgctggcccacaacatagccatcgctgacccaccagtgttcagctggtgacctgggatcagtccacccctccttatcacagccagctaagggggaggtatatagcatcaaatgcctatatcaaaaagatagaaagatctcaaggaacataaaaaaagagaacaaaccaaacccaaagctagcagaaaaagagaaataacaaagatcagagaagaaataaataaaattgagctaaaaaatgtaaaaaatcaacaaaatgaaaaattgggtctttgaaaaaattaatgaaattgatcgaccactagctagattaagaaaaatgagagaggattcaaatacgcacaataagatatgataaaggtgacattaaaactgataccatagaaatacaaaagatcatcagagactactatgagcatctccacacacaaactagaaaacatatagaaaatgaataaattcctggaaacgcacagcctctcaaggttgaaacaggaaaaaatagaaatccagaacagaccaatatgagtagtgacgttgtatcagtaataaaaattttcccaacaacaaaaaagccaagatcagacagattcacagcaaattctaccagtcataaaaagaaaaattgataccaataccactgaaactatttcaaaaaaatcaaggaggaaatactccctactcattctaagaagccagggtaaccctgctaccaaagccaggcaaggacacaataaaacttaagagtccaataccattaataaacatagatacaaaaattctcaaaaaaaaaaaaagctagcaaattgaatccaacaacacatcaaaaagatactactccataataaagtgggttttatccaggggatgggggatgtttcaacatatgcaaaccaataaatgtgatttaccacataaatagaataaaaacaaaactatatcatatctcattagatgcagaaaaagcatttgataacattcagcatcactccatgataaaaaccctcaacgacctaggcacagaagaaacattcacaaaataataaaagtcataagacaacaaaccccagccaacatcttactgaactgggaagtgtctaaaacgttgcccctaacaactagaaaaagacaaggatgcctacttttaccacttctattcaacatagtactggaattcctagccagaacaatcaggcaaaagaaagaaataaaaggcatccaaattggaaaagaggaagtcaaattatttatgtttgctaatgatgttatcttatgcctagaaaaccctaatggcttctctgacacactcatcaattgattggataaagaaaatattgtaagatatataccatggaatactactccactatgaaaaagaatgattttacatcttttacagcaacatgaaaggaactagatggaggccattatcctaagtgaaataactcataaacaagaagtcaaatactgcatgtattacttgtaagtgggagagctaaacaatgggtgttaactaaacacatggacatacagagtagaaaaatagacactggacactccatacattggaagggtgggaaaggggtaaagactgaaaaattacatagtggctatgatgttcccattcagatgatgggtactaaaagcccagacttcatcactacacaatatatccagataacacaacttcacttgtaccaactaaatctataaaaataaaaataataataataaattataacagagcagtgatattatatgttttatctcatttaatcctcacaacaactctataaatttacaatcacccttgtatctccataatgaagaagagataacaaaagaacataatgatgaagaatttgtccagagtcatacaagctaatagtggtggggacaggaattcaatcctaccatgtggctcaaagcttaaacccttaaccacaacaaacattactaatctttaaattaatcatttacaataaactaaaatagtgatcagttacagacactcttcaacttacaatgtggctactgcccaataaacccatcataaattgaaaacattgtaagttgaaaatatatttagtacaaataacctactaagcatcatagcttagcctagctaaccttaaatgtgctcaaaacacttacattagcctacatttgagcaaaatcatctaacacaaacctattttataataaattgttgaatatcttgtgttttttttaaccttcatgatcacatggctgactatgagcttcctagcatcgtattttaccacatatcactagcctgggaaaatatcagaattcgaactttgaagtatggtttctactgaatacatactgtttttacacatcataaagtcaaaaaattgtaagtgaaaaatggtaagtcagggaccatttatatcgaaaaaccttgataaaatccacaataaaataaaattcagtatttaaaaagaatgcatggtctggtatgtatcaaaatccaaatgtatgtttttcaagtgtgattagctaaaagatgatggaatttttacttaatctgaagaaaaaaaaacactatccctagcatagaaactagtcccctctttccattcttgtttcatgagcttcattcttctagagaaatgataaaaacattatcctaaatccgtaattttaagtgtaaaataaactttaaaactataattttatataaatacatggttatatcattatattaatatggatttcaaaatatattctgcataatttttatttaatataacttgctaattttaagtgaatttttcctaaacatttggcactgtttttacactataatgcagaaaactgaaaatgagtttcagcatataattctaagccaagtgtctgttaacaacatacttttagtaaaagtagccaaacgaatatttgtagactggaagatcaatgctggacttgcagagtaagcttatatattttgttatacaaggatatttggattaaaattgagttaaaatgacctccaattggaaaatctttttaggcagtttgtacaactggcagaaacatgctaaaaatgtaaataaggactccttcccaccacagatgcttcctcaatgatggaatatccaactgcagttttaacaaatatcttgttaatttgatgaatgccagatcagttgtgctaagcttcagaatccatttgagtttaattaaattattcacatttgccaaattaatatataagaaaagtggaacttttgggcttcgtctttgccatcaatatatgtaaatggataggtcatttaaaaatttgccaacaacaaaacacactgtttattgtcttccgtctatgtgctggacacaatgctaaatattttacatgtattaactcattacgtgtgataactttgaggtacagattactgttatccgtagtaacctatttcacaaatgaggaaacagagataaagagggattaagtcatttgctgaaggtcacatagctaataacaggtaaagttgagtttcaaactcccaaaacacaagcccttaactcctatctcccatacacaattttccctggtgaaggccaaggatatacatatatctatatctatatacatagatatatatatcctttatatatatattcatatatacacatatgtggctttcaaatatatatattcactcattatccagtcagcataaccatatgcaatgacagatgctaagaacacaagataacatcagagtttaacaataccatggtctacttcactaaatctgcctaatttgaatttttaaatagctttttattatgttttgacaactaacatgggatattctttttattcaaataaaataacattctttctcaaaatcattttaaagaatgtttaaattctttattctaaattctggcttgtctacacagtgtttttcaggtaaatcagctgtttaatcactgcatacaatgtcactctcctgtgctttccagccaaggcacctgctgcttatcttgtctgggacatccttcttcttacttttccttctttcttgaaaaacagatcctttattttcgggtcaagccctatctacttgtgtcatactgttcaagttccatggctcaagtgcttaccacagagtaggagtcacaaaaaatattgactcatagctcctgtataattcgttttcagatcattagaagcagatcccaacaatttaattcaacctgtaagtgccttttagctttcacacttttaacttaggaaatattagcatttgtttataatttttacaaatttctggacagcaatttttttaagattccttaaattactgccaaacatcatatcaaataagaaaataatataatgtaataagaagagtattctactaccaagagcgggggttttacatttaatattgttattagctctttattagatgtgcagcattcgaactcagagtccagttaaaattgccattaaataaacctaacaatatagatttaagtcagaaatgattatggctaagttctctaaaactgtaacataatatacaaatattagtatacataaccattaaattctttgaagaggaaactgctttttacctatgtgttatatttaaaattgcaaatgatgctgcagtaccttcaatgataactgaaaggaaaatatgtgtaaattaagagaatgtctatattatgaaatagtttcaaagaaataattcattcattaaatatttgttgagtgcctaccacactgcaggcataattctaggtggtaggcacacagcagtgaacaaaactacactcctaccctcatgaagtttacattgcagataagtagaaaataaataaacatataatcaatgatgatcaatattacatagacaaatgaactagcttcacaaaactggagagtgcaactcagcttttactattttacaaagggctatcaatgtaagtaacatttgagttgatatttactgatatgaggaaactgtgagggaagactatttattggaaaaagattaagggcttaattttgaacacattaaaatagtgatgcctattagacatccaataaaggtgttgagtaggtagattgagccaaaacttcaggggagaggtataaggtggatgtgtaaattaggggatgatcaatatagatagggtctttaaagccaacagaggggttgagattgctaaagagtaagtatagatggacaagattagagccctgtggcattccaacattaagaggtcaatacagaaaaccagcaaagaacagagaagaaacagatatcaatgtcaaatgaaatcaagaaatcatagtgtcccagaggaagccagctgaatgaagaaagtcatagataaggggagggatactgtactataaaatattcctaatacattaagaactgagaattgaccattgtatatgagaatgtggaagtcactggttgaccttgacagaaacagttcctggatagtagtggagacccaagactgaatggagagaattcaagagagaatgggaatccagtgattccagttctaggtatacacccaaaagaactgaaagcagggtcttaaagaggtatttgtacactcatgttcatagcagcattactcacaatagccaaaagggggaagcaacccaagtgtccactaatggatgaatagttaaacaaaatatggcacatacatacaaaggaatattattcagccttaaaaaataaagaaattctataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactattgcaagaacaaaaaaccaaacaccgcatattctcactcataggtgggaattgaacaatgaatacacatggacacaagaaggggaacatcacactctggggactgttgttgagaggggagggatagctttaggagatatacctaatgctaaatgacgagttaatgggtgcagcacaccagcatggcacatgtatacatatgtaactaacctgcacattgtgcacatgtaccctaaaacttaaagtataataataataaaataaaataaagtaaaataaaaaaataataaaaaaagaaatcctatcattccacaatatgaataagccttgaggatactatgctaagcgaaataagccagtaactaaaaggcaaatagtgtatgattttacttatatgaggtagagtagtcaaattctcagagacggaaagtaaaatactatttactaggggatggggggaatggggatggggaagtgattgtttaatggatacagagtttcagttttgcaagatgaaaacagttctgtgaatgaagcatagcaatgttaatatacttaatgctactaaactgtatacttaaaatagctaagttgacacattttatgttatatgtatttcactataattttttaaatgttcatgaaattggtaccaatgagaagttaaagagcagtcagaagtcataattttctgtaattttttcatttcacattatagcttttaagagaggatatatagtctaggcgtggtggctcacacctgtaatcccagcactttgggaggcagaggcaggcggatcatgaggtcaggagatcgagaccatcctggctaacatggtgaaaccccatttctactaaaaatacaaaaaattagctgggcgtggtgacgcgtgcctataatcccagctacttgggaggctgaggcaggagaattgcttgaactctggaggcggaggttgcagtgagcccagattgcgccactgcactccagcctgggcaacagagcaagactccatctcaaaaaaaaaaaaaaaaaaaaaaaaaaagagagagaatatgtcacttgtgagaaaagaaaaaaaagacatacacaaatgtccatagcagccttaaacataatagcaaaaatattgaaacaacccaaatgtcattcaatgtatgaatggataaacaaattgtgttataactgtacaatggaatactactccataatacaaatgaacacattaccaataaatttaacatggatgaatcatgtggagcaaaagaagccaaaagtatatactatattattccatttacataaagttcaagaacagatatcactaaatctatagtgttaaaaatcaggacagtagttgccttggtgttggggactgattggaaaaggcacatgagaactttccagggtaaaggtaatcttctaggtcttgatagaggtggacacattaatcaaaaggcatctgactgtacatttaagtccatccatctcatagtaaattatgcctcaatattaaaaaaatagacaatgggaggatagaatatgatgacagcaagtatagacaactcttcagaagagttttacaataatggggtgcaggcttggaggtcaaaaagaattgttgttgtagttttggtttggttttggttttggatgggatatactgcaacatgtttgtgtgctaataggtatgactcaaaggagcggagacaaggtctaagctgatgtctttaaacaagaatgagaagatgagattcagagaataagtacaggtattgactgtccccagcagcatgcatgctcaacccacagtaacagtaatgaagaaaaagtatatggctaccaagcaagttaagttgggagaggtgtatgaggccatgtgaaagttctattctaactgcttaatatacctactatacagtatatgtatatatactatataacgtacataccagtagagcagctttgttctcacactgtccacatactttcccatttatcttgggtttttcacattctgaagaatttgccattttataattaactgttggtttcactggctctgcaagataaaaaataatattactccaatcatttaaaaatatgttaaattttccaattgataaattaatgaaactatgcatacttcccatctctgtatcaaactgaagcccacatagaacaaattctaaacatttataattatatatattcataataaatatatgtatataaatatatattatatatatttctgaattttttctaccaaactatattaatcatgcaacatttgtgtttactatcctccagaaaaacatcttatttccttgggaattattataaattcaaattatatttttggttttgctattattaaataatttattaaaatataaagcaatttttctatttttaaaaattttctagagtgaaattttaatttataatttacactgctaaattatcttccttattaaaacattacatcaataaaatttaaggaacagtgctgtaaaagtcctcacttttgaaaaatactattactataatcatgtactaagtttacattttttgacacaaaagcccccctaaccacccgaataaaatttatgttgaaaatcaatgtgtcatgatttgggggtttagaatctttatactgcccggacaattctaaaactttaactttatttgtaattacaatgtaaaagaaagggatgtctttagcatttattaacatggtgataaattatttaccttgaatctgttccttcagcaattttaatttcacttttccagcagaaaactgtattaataaaatagatactatttgtcaggtatatattatcttattcaacgaaagttgccaacaaaaatattagaaagctgtagctttggtgcttttcgaacaaaaatttatttttaaagaataatataaaattaataggagatcatcattaaagcatatatgtaccttttaattaatctaatagaaattcataaaaaagaaaataaattttaaaaatatatctaaaccagtttttgaaaacataatttggcttttaaacaaaaaccattatatctcattatgaaattatttgctagtattcaaatattgtaaaggtttaatacatcttttctatttctgctctttctgagacacacagtctaatatttgtgtaagctgaatctaaactgaattgtgactaagctattctgcttacactactatagaaacccatattattttatttgcccaatttagagaactgcatgtgtaagcatcacagacttatccttcaaaagtattatttgtgatcactgactttcctaaatattagccaaaaaaaatgaataaataagattcactgctagatatttcaaataaatcatcacttaaaattttgggattttaatattttaggaagtaaaatactcttgccaattgaacatgcttgccttgatcttattaaaaccaacatttaaagtacacaaacgagaatgaaggatggtgtgcatttatatagatactgtcaattcaggcctagttttcaatttgcaatttgcatgctcaattgctcaatttgtacatgagaatctgagaacaatgactgcctctatatctatggctgtagcaactgcagtcatctgaaaatgtaggcctaattattctcagtgaatctagtggttttgcttcaaaggggcagttatttttcacattcttcaaagtaactgctcagatgctatgtactaaacacagcagaaaagaaaataagattgaaatcatcaatttttctatgaaccacacttttatttttaaattgctaatgttatacaagttacagataatctaatctcatttttcataaccaaattatccagtatgactaccttaatgatacatctgaattgaaacatgatcagtgtggttgtaggctaccctggatggaatggatagatatgcccaagcaaaatgaacccattattagggaaattgtataatttgtttttattattatgaataatattgttctgctctatgaatacagccatatttatttcaagtgattcaaactgcataaaaatatttcagtgaacaaacctctagctgctatttttagacaaatagaatttcctcataggtctgatttttatctgttagggaaagggttggaggtagggttgaaccaaggatacacatgcttacacaaacacacatatacacatatatgcgcatgtacatatacatatataatacatgcatatgtatatatacatatagatagaaagatggatatctgcatatgtttgtatatacaaatgtcaggaacttaatatactaaagcctatgccttattaacatgctgactcctccaccagtaggtattgaaggggtgctatcaggggccaggaaagcttagtggatttaccacacagacatattatctatgccactggggtcagaatatgctgtcatcatcagcctccctggcattcacaaatacctccgaactcccaccaatgccttcatctgccacactgagcccaaacttctcctacagtcatctttcagacgttctcactgtcaacccagttagctactgaaacttcgcaattctgtactaattgtccttccttccaagcccccactgccattccgtggatcttctattaaatagtcatttatgtatcttatgctttaaacctttcccaaaaatgtttcatcaaaagtttacatcaactgaaagccacctttgcttagacacaatcttcaccaaagcacttcccacaggacctagcccctttccacttcctttcacataccaggaaagagaaaatttttctatttgctcttcagtgctgtttccagaatattattgtgctatcatgattcagcaaaggtgcctctactataggtccccaccatccacttattgcttgtgtcaatatctagggtctcttccacctgaacttcagcaacctgctcggtatttctctccatcacatttctgcttgacagtcttagagacttcaatgcacatgttcacctgacatcctggtttgaagaccctccaacatgctggctactgtgaacatctaaatgcctcttcagccacctcaccattataaccaaatctggcatgtaagcagcattctgaatagccacaccttcaaaatctcagactctaaagtttttcagtgccaacctcaatcaccttatctcttccttctgatgcctccaatatctatgtaccactgtgataaaaataatactatagagcctcctacaaatccatgctgatcagcctcaatgggctatatggctctttggcaatccatttactcatttgctgctaatccccaaccacaattcccacagtggctactccaaacctcttcattcccaagaactcaaattcatcccatttcccttaattcacctgagcagacgatattgtcttcaactgtcctaagaaagttgaggtcttcccattaaaatctttcagtgtcccacctcaccacttgtcaaaaacaatctctaaaatttattttcattgccacctgttttttcttccacctttcttgtctcacacacacacaaaaaatatgtcttcctttccttggtgaaggcctctttaatggactacctcttcaaagaccacacacccagcaactggcacctctttcatctacattttgactctttcctctactaggatgtccatctttcattctacaaactggcccacatcatcttgacaattctagaaaagaatataataaagtctttccttgattctattaaacccttgaaaggtcaccaactgctttcatgctggctgcaacaatagtctttactcattgcttcccaccgttttcttttcaaccaattgaaatctactctcttatttaatattgacacaatcatcaaatttaggtcttttaaatattttcattatccagaaatagacattttaatgtaatgtttaggtatcattacaaagtggtttcacatatttcaagagtttttgacattgctcaaaagctctttgaagtggttagtaggtattattatgcaagtttacaagtgtagtaatagaggcttggaaaggttaagtgaatgttaatctatataatctaatacagagtttctagacctcagcatcactgacatttggggccgaataattctttgttgtggggattgtcaagtgcattgtaggatgtttagcagcacccctggcccttactcactatatatctttagcaaaaaaaaaaaatacgcaaaaacaacaacaacaacaaaaatatacctctcaatgttaacaactgaaaatgtctccagactttgtcaaatgtctcctgggaagcaaaattgcccccttcagaaacactagtctaaatagatactcaaaacttttttcactacacaatatattggacattattgacttcatattttccaaaaatgttctcctttactttcgtccttataacattgaactacttcgattttacttcgccattctttttcttctcaatctctcttcactagagagctggcaaattatcttagacaagcctgagagcttacatgtcaaatcttggccctgacttttgaccttgagtgagttatttagtttttttttatattaagttatttcatctgtgaaactggaataataataacatcctcttaggagtgatataagcacttaatgagataagaaaggaaaagaagcgaaactgttgactggtattaaaacttattgagcttattgagtgaatattaaagttctctttgccaatatagtttacacactggctttctttaagctttattctttacacctctctatgttttacaaatcctagggagtacatttactcccttaacttcaactatcacttgaaaattcaaacaaaactctaaatgtataccccgtacttttctaagtcctttctttatgctgtctcttagtcaatccagcctgtaatatcaattatatgtttgacttcctcctctcctttctcactgttttatggttccatatttttctttatatatgttttcctacccttttaattcagcctcctttcatctgacctctagattattttaatagtcttacaaatagcctgtttctagtgagataagttttttttaaacgttggggtcaaaacttttataattgatttttccctaagatagggaatgacaccagagaataaaacgctttctcaaagccaaaaactttagaagcgccaagtaagatctttgtagattccaactgacccaatgaaagtttaatgataggtacgtaaaaaataaaaactgtgtaagctaatacttacaaagtcacgaatcttgcactaaagaatccagaagcaaaattgttttctttatgtaaagacacttatctgattttcatcttaaatataatattatattttatagcacacagtaaaggagcagcaattctatagctgggaaactgaaaagtatttttttcttgagtatctttacacatggaatcaacagtatatgaataataaattattattgaagcagaatataaaacattaaactaatgtgatataaaagtaggaataaagtctctcatttgttatattaaataacaatagctttcaccttagtttagaagtatttagttctattttatatactttaaaccagatccacactgaatggaaaaattcagtttgggatgtgggaaaattcactgcaaggtaaaattttgaaatcagtttgtagctgaaaaacaaaaacataattgaataatgaaagttgcatattaccctgcaaaataaatcaacaagtgaataatatgcaaagttgttaaaataagaagagtatattcctgagtatagaagaaaatgcaagacctaaaaaagaatatcttcttgcttagcaaaatgcataagaatcaaatagtatcttcttaccttaacaacatttcctttattttgtgacatcatatatgattgattgaccaatttgcccacttttccagatttccagtaatactcgcttgacctttaatatatataaacaagataaaatgtaatcactaaacacatttctccctttaatgaaaagaaatacagtgttcctgtttcagaaaatggaaattcagttgttaacatgcagtaaacaagcaaaacatgaaaaataaatatcaataatgtcacaatatcctcagtaattttaaaatgtagctttatcatatttatgacctttgtggagaaatgaataaaatgaaatgtccaaacacaaatgaagaattctatttccttgatattcacaatgactaaagatagctttattgatttgtaggaaactttacaggtctttatgaaattttaaaagctaaatgtccacaaatgtaaagaagaaaagcaagcaaaccaataccccaaaatattcagtggatctagtaagtgatgaattccttgttaaaacctctaatgatctcccacattgaaacataacagagattacaaagaaggcatactttagctgtacagtttttaaagcacttgagctttgtttacttgagcataacaaaatatttttgaagttatcaaggcagagagtccaattatcattaaaaaataacaataagacaaaaagttgcccaacatcacacagaataaataattaagattggagcactagacttctattttcctggctagtgagtggcaggttctcattctggctatgacatttaatatctgtgtgacctcagaaaacaatgtaactattctgaaaactcagtcaagctttagaatgttaagaatcatctagaaaagcttccacagctaagaaaaactcactatcagggctgattccagcaactccgattctcagatgagtatcatgatccatttagaagtccaaactaagtccaaatcagtgaaggtaaaagaattggccactgggtcattaaaagcagcaagacacataataaactttgtcatcctggatgacatacaacatgagatgctctgattaaaccaatgctctattagagggggtatgtatataagttatgcatatttttcaaagaaatggactctaaagataaatactactgaaagtataatgaacacatttgaattgtcattaaacgttaagaaggtacttctaggtatttgatggtcatcactttgaggactaaacaaaagttaatttaatatacaaacagtttggtgatatttagtaccagcaaacggacatgaaacatgcactctcatacactgtaggaaaagattatgaacttttgacacctatttggaagacaatttctcaatgtctatcacaatgtaaaatgcaaataacacattgacctaaaattacagaggtaggaatttatcccacaaatagctttgcatatgtaagcgaaaatacatgaagaagcatgttcatggcagcatttataatcataagatactaaaaacataataaagatctgaaaaataaatgctattatatccacacaaaaaatactacgtagccactaagaaaattaggctaattttcttatcacatcaatgcattctgatgtgataggagcattaagatatattaagtaaaatagtaggacatgaattaattcccatatttttagatgaactcatttgtaaaaaaaaaaaagtaaacgatacaatatatgcaacagatatactcactgaaaacaaaatacattcacacacatgtatatacgtatacttacacaaagataagacatttgtggagaaaatttttagtcattaaaatgggtgctagaaaatgggctgggagttagcctagagctaagaagagagaatttccatcacataattattagttctgtttgttatcatttatattattttataacaaaacaacaaattcagtataattagtacaaatatataagcataatattagaaagttctcattaataaaatttcagctaaccagcatttgctaaatatattttaaatatacataagggtttgagcaattctgattatatatatgtatatatatatatatatatacatatatatatgtaatagcatttatttttcagatcttcattatgtatatatatgtgaactcttgctcccaaaagcttttgaatacataaaaatggctctaaacataaactggtgtttatttgttattgatggcaattttctgagagcaaaaggtaaagtgtgcactgctgtcataaacattccagaccataaatcaatgagaagccaaaagttaaataaaaaggaaataagaaaggataagacccaataatgttcagaagaaacaaaagtaatggtaattttaaaaagcaacatgtctcatctaagtggcacaaaaacaaaaaatagaaggcctttgctattgctcgttcatcaggaaaagtcagaaattatccatccattaaatgtttttattggaatgacaacagtatataaaatagttctttatataatttagttgattcatctaaaattctctaagagtttcactcactctctatcttccttttctttgtttcttgtggatcggaattcttgcagtttcttctccatctcttggttctcaaactctaactgtactttctccattcgcagttcttgagcatttctgaagacataagatttaaatggagaaagcagaaaaacaagcgaagccaaaataattttatataatcttttcctgttaaattagaatcatgaataataaataaaatattttacctatttcttttgtacttctccgaaatctggtttttaaagttagcatttgccttccatcaaaatcctgaagcaaattatctcttcaaatcttagacttttgttttaattattacattgctaggggttcaaaattataattaacttcatatataaggcatgtttttatatatgaacaaatatctatgacatacaaacagaaaacgaaataaaaatattgtccaattttcatattgttttgcctccaatgtagtcaagtagtttgaagcacagtatttaaaacaatagacgaaatatacatttttgctgaactggtcacctccaaaattttaaatctctacctttatgtcatatatgtatgatgaggaggaaaaggtagtacctgtttgagacctattaagaataaagcccctattaacagttttggtacgggagcttcctgtacaagagattttgataacatctgaaactcactaagtttttgacaaaagacattttcttcattttacgaagtctggttatcagtattagccaccgactctttctttcatagatctaacccaaactaattctctagcttttactattgtaagtccaaatctcttccttcaatattacattagtgttttactacaatcaagcagtgtgggcacccacgcatgctatggcatggaacaaaatcaaggcataataaagttcataaaggagaaatctttctagaggtagcaagcaattaccaaaaagcaagcgggccaaggatatgtcctaagcggacacaatcgaggaagatatacagaaagtgataggaagggctgtccagagggttcagagaagctggctaagatacagaaagagaggcatttatttgcattgtatctactccacaatgagtaatgcagctactacctcaaacaaacactgctaggtgataggatgtgaaatacaatggagcttccagtattgagaggaatagatgagcataaaggtaattgaaatatagtggaatagtgctgtcattggggaagtacagggggctacctgggcacaaagaaacagcacataccccagccctgtgaatgcaggaacagttcctggagaaggtgaagtatgagctgaaacctaaaggatgaaaggacttagccagtcaaagggaagtgctgagtgcagtgttccagaaagaaaggagtgtggacataggtagcaaagagcaatgggtgggtcaaggaactagaagttctctgtgaccagacattaagtgcagaataggaaaagtagcaaaaaataaaactgctgaagtggataggatcatgaagagccttgtaagccatgatgagaaattgggatttatattgtatgaacaatgaggatcattaaagggttttaagagaattgatcagacttacatttagaaagatcactcaggctgtatcaaaggaaatcaattagagggtgcaaggctagaagcaagacaaccaattagtagactattccagtaatccaaataatagagaatttgggctagtctgactgagcaggggcaatggagagaaaaatggagcttttgagaaatttaagaagatataattaacaagttggaaactgaccagaagtaggtgactgattagagagggaacaaggaagaaatctaaaataatcccatgtttcttatttgagctgtcaggaggacaatggtgtcttttcctgaaacagaccattctgaaatgggccacaggtacagttcaggatgagtaacagtttatctccatgcttaaagtcttgaaagcctaccacacttcacaaactgcttacaggagaagagttaaaaaaacaaatatgattgtgtcactcatttgcttagaagacttctgacgtttttgaagtcccactgtggtagaggaaaaggttaaggctgtagaaaaagagtggcctactgaccaagcggtcaagtttatgcaaggttggattgtatggatctcacacaaaacagaggattccccctggagacaatgttatacacggagccataaagggaaagcaaggccacttgaggaaagctaaggttgatccttagctttatttatttaatttattgtttaagagatttctttaagatttccaaaatgataagttcagcaaaaatatgtatgttgcctatatagaaaaaaaattgttattttaaatattatgcatcaaactacgtgattagaggcaacacagatgatatgaaaattagaaaataatttctaatcaacaaaacaaatccaagggctagaaataagattgaaatggtttaggggctgagaaagaggtcaggaggactggaagaacaccagaatgtcagacaatgtaaaggcaatgtccaaggagaacaggcttggaacacggaaaaagtgagaaagagaactctacggtaattactgtgagtgggtattcctgtcctggtttttaatggtttgtggatcagggagacgtacaggccagggaatagtgattccaacctatttccaaactctttactatgacatacacattagttatcatctagaccctgcctttttctccacctttcttcttagacaattggatatgtctgagaagtccccaaaatcatgtggtctctgagaagtccccaaaatcatgtggtctctgtgtctttgcataagtttcacccaataactacccaactaactgcatctctcactcagaacttgggtacctcctcactcctgctctagcagtttgagccatgttctctcctagtcccttgcctttacacatcacaccatgcttcattctatattgtcagtgtaactgtactcattcatattctctctaagctttcggagtgccaggactatgacttcctgcttttgtagccatcattccctagcacagtgtatagaaaatgcacacttaattaatgtttgttggctaaatgtttacaggtatagacacgtggccctgaaatatgtcactaaaatcaaataacacatgtccctttttctttttctattaacaaaattggtagtcctagcaattagatagctcccctccccaccaaatacatggtatacctaaaaatgataatgccatatatttttataacatttccagtttacacaatacttttataccccatatctcaaagtgaagagagcattagaatagctttgaagacaccaaataaccacaaaactattgatctggatcaaaaaactcagaaactccaattaaaaatgatagtctgggctgggtgcactggctcacacttgtaatcccagcactttgggaggtagaggtgagaggattacttaaggtcaggagtaaaccaacctggccaacatggccaagcaccatctctattaaaaatacaaacattagccaggcatggtagcgtgcgcctgtaatcccagctactccggtggctgaggcaggagaattgcctgaggccgggaggtggaggttgcagtgagccgagaccgtgccagtgcactccagcctgggtgagggagcaagacttcgtctaaaaaaaaaaagtctgtcttcatcctatgctggctggctcttactgatattgaagaggaaagccctaagtatttccagtgactgtaggtgacatcaaagacaaacagggagctatactctcccatacccctgcaaggtcataaaattcccaggatgccagtaattgtttggctctggctgaatgcatctcccagtcatctaggacagacctctcctggaaaaggtcaattcaacataacatcctttatgtaaagggctaaagtatgtagtgctttctatttcctggttagggtctcttatcctaatagtctccctaaatttcagggtaatccttacttaactttgaataagggccatgaaaaatatgtttaacattctgttgtattactttaataggtaatgaaccaaacctttataacttgtcacattggttcttgtggaataaatatttttaatcctcatttttaaactattatagatttatagtatttcaaagctatattcttatagataaaaatacaggaatgtgaaaaatgaagataagaattcacaaaatagtcaaaattacaatatacagaagctttgcaactattcctattaagaaataaatatatatgaactcacctatattttagctttacagaatttccaggttttccccatggaagaactacaaaatcttttctgttcatgattaccaccttaatattgtctaaaagttattctgatttgtaaacacttctgtaaaagtaacaaagacaaaagaattatggcagaggtgaagcagtataagttacaaattcaaaactccatataattcaggaatgtttttaaaaccttatgagcaaaaaggctgaatcaaaatttaaacagcaaaaattatacactgttagccctttgtccccttcagccacatatcaaccagataatcaaaaatattagaataaaaaatacaaaaaaagtacaactatttacatagcatttatactgtattaagtattataagtaagcaagagctgatttaaagtatacagtaggttatgtgtaggctatatgcaaatactatgccattttatataaggaacctgagcatcctaggattttggtgtttgcagggtgtgagggagttactggaaccagtctcctgtggaaacctagaaatgactgtattttaagttatgtaactatttatgtgctaataaagttagaaatgtaacacgtctgatggaattaaaatttcaccaatatttatgtacagctgacccttcaacaacataagggttaggggcaccaatcccccaaaaatctgtgtacaacttctaatttcccccaaattttactattaacttattgttcatcagaagccttactgataacataatcaatgaatatattatgcatgttatatgtatgtacatactatattcttttaaaaagtaagctagataacagaaaatgttattgagaaaatcataaagaagagaaaatatatttactatttattaagtggaagtgaatcatgatcaggggcttcacattgagcaggctgaggaagacgaagatgaagaggagttggtcctgtctcaggagtggcagagatggaagtggtagacgacatggaagggaaagcaagagggacaggcacacaagtgtaactattattttttaaaaaattatttataagtggatctgcacagttcaaacctatgatgttcaagggtaaactgtatagcaaaagactagggaaatagtcaactaaaagtgaaggatacattcattaaaacaaactaaagcacatattctggctctttctattgctaaggctataaaagtataccaagtatttgttctatctaaaaataatatccaaggccgtgcagagagaaacgaaaagaatctttgagatacaatctaaacccaatatcctttttatatatatatatggttatataaaatgaaaattaaggtatgtaataattacccaaaggcattctaatatcctcatttatcaaagaaaattttaatgatactctttggctcagatcagaaattagcatattttagaaagaatttttcaacaagaaacaaaaaggattttctgcttaactttgagttaaccagaaaataaaattattcagaacaccctgtttcccaagtatcccaattattcatggttctataataatttactctgtaatgctgaattactaaatcacatgaacaactattagatttttataggaataaaaatttccaagttctaagagcttttaaagaaatatgagtcaatattatagtgaccatagacttaaatgcccacaccatttgatgctgtcatttatatatgtgttcctatgtgtgtgctcataaccacaataaacatttattaaggttctgctatatacaaggcaatgtgctgagaggtatggagaggagtcaaggcccagggaggtttgttttctgagctcaaatggtttagagtcaaatagggcatataggaccctaaatataaaagccataaaacaaggtaaaaattataagggctataaaatttatacatgtgataatataggaagtgaaagaaaagagagaattcagctggctagcatttaagtaaagctttgaaggagaaaggaggcttacagataaagatatggattagatgaacaatccatactgttggaaagaatagctcttggataagggactaatgaatagttacacttgcttggtgtgcaggttacgtggaagaaaaaaaataaacatgagtttagatatagtggctgaggcccaataatgagtggctttaaatgtcaagtttatagcatttggaatttattctgtagctaacaagagtctaatgggatttagcagggaaaacgtaagtctagaagctttgctctaagacttaaggaaggacagcaccaaaactggagttacctaataaaaggctattgtgacatcaaagtctacacaaccaaataagtggttcttcatcgttgttcctttgggagactatcttatatttcaacgatgcaaccactgattgaaaacatttttgggacgcctcttttgaaactgtctagagaatccattttatggctggacgcggtggctgacacctgtaatcccagtaccttgggaggccaaggtgggcagatgacttgaggtcaggagttcgagaccagcctgactaacatggtgaaaccccatctctactaaaaatacaaaaattagccaggcgtggtggcatacacttgtaatcccaactacttgggaggctgaggcacgagaatcgcttgaacccgggaggtcgagattgcagtgggccaagatcgcaccactgcactccagtctgggtgacagagtgagactctgtctcaaaaaagaaaaaaaaaagaatccattatacaccaacaaacacacaaattcatcttgttgtgcctcatttgaaattaaaaatgattgtgcaataggagcaactatttttttttcactcaaacctacctccaaattacttggactatctccaaaaattaaatctaacctgaaagggtagatcttcaccattttggaggaaattctctaggaatttattctctaaatataattgcaaaatggaattacacaaaataattactacattttaaataaggtagcggttgccttatgggactagttatgtttgtaccttcaatccacaaacatgtatttaactgttcctttgtgatccctattagtggtcccaggtattgaagtcatgatggcaaataagccgtggtgtcttcccttgaggccctcacaatcaaggggaaatccacaaaagcaaccacaatatcatggggcattttgatagaagaatctacagcaggcgtctcactcagactcaattttcaaccaccaagtcctgtctctcaaagctaaattaagtgtcaacaagaaataaagataccataggaatggcaaactaagatttggtttgctttttgggagggaggtggtagcattttcaaatgtaattctcttttttctccctcatttttgtaggtagtatatttgtcccattttcatcaaatagcagctaccaaaggcacctttcaaaaacctccaggaataatcctgctccataacatggaatctgtattgctttctgatcatattcagggaatccaaatactggcctcttgcctacaattgataactttgtcacaaaaacttccataatgttattattatcattaaagagataaaataatttccaaagttaatctgtctgattattaaaataatctaaataatctaaattgctataattttgcttacacattgagatatacaatataattttatgtgtatgtacatatataaagctaaactgatatatgattgattttactgatacaaaaaatgaacgaacttctgtaaatctcattacaataagatgactcagatttatagctctgctgataatgttatttaaccaataaatggtcttattcaagggggatttcacttcactgaatgcaattagtaaggcttcttctcaattacatattttatctagtcacctacataagctaatttccttgtatgaagaaaaaggggagattataattctgagtcatattattctgcctgtttccttttgtaaagccaacagagaatttagtcacctttctggggatagcaaggatataacaatgtcagcagcaagaatagcaaagcacaaaattttagacacctaataaaaccagaggaatacagataaactccttactatgcaaaacttatacttccttgtgtcttttggtcattcagttttttttataactaaataccaaaaatttagtagtgatttggaaaaatttctagttacctgatttattagactacattatttttctgtctacaaccccatttttcctcacacaaaatacccaatataacccaaaattgtccatgatggtttgatgatccttctacacatgttcctattttgagaaagcaacccacacatcaaaacctactgccacagaatggaaacaaggaacgtacaatgctctatacaggtagaaactcagagcattcagccagaggtgcaagagaacaccattggcagaatgggaggtttgggaaaccactgtttacaagatgggccactttttgtaactgaaaacttatctaagtttagttaattcttctaatgactcagatcatgctaggcacaagacttaaaaaccataccataaatagggattttcccttactgtagcaatattttgaaatggtctaattagcaaacaactttgggtgaattaacatgtttaggcatttagtaccatagtacttagaaatcagagacccaagaaagaaatgttaaatgagaatttaaaatagttgcttttaataattaaaagaattttacttttcacatttcttctatctgtaattatccttattttaaatatatatattttttaaaatatttaaaaaattataaggcaagaactgataatacatgatttctagaatagtatcttgtgctggagtgtcctactaaataaatgtgtgccacattctcatagcaaaagctctaaaagtaaagcaggtattgatatagtttggctgtgtctccacccaaatctcatcttgaattgtaatccccataattcccacatgtggtgggagggccctggtaggagataattgaatcatggggacagtttcccccacgctattttcgtgatagtaagttctcatgagatctgatggttttataagggctatcccctttcacttagctgtcatccttctctttcctgccaccatgtgaagaaggatgtgtttgctttcctttctgccatgattataagtttcctgaggcctccccagccctgcagaactgtgaatcaaacctctttcctttgtaaataacccagtcttgggtatttcttcatagcagtgtgagaatggactaatataggtattgacttcaggttgcattcaatctttcagccaaacaagatatctgatagtaaaatactgcttcaaggtgctaaatggtacccaagttgcccattttttatgctctataggcaggttctcttgagaacaactgagaaactttgcctttagatatcaagggacaagataccattttaaaatacttttgattaaaaataataaacaatattaaaaggcactgaatttaaggtcagaaaacctaggtagactaaattcactggatttaaagtcataagatctttgtgtgatagaaatctctgagcttcagcttatccatgtagaaaatggtaaggatcctctccccctctaatttgcaggatattaaacaaaaggtgtctgatttgtgacttgacttgtcaagctgtgggcttctataagacctccagagagctcacggttcagggaaaggggcagccttagaaactacctagagaaggcacagccttagaaactacctagagaagaaaatggagcatcaagattgtgctttacccttagcatctctgctttcatcttttttacataatgagctttagtgtttacctctctgctcaccaagttttattctactcaatgctcaattcgaaggctgcctgtatcatgaagattccctccatcgaaaccgagcttctccttgtatagaaagaccatgtttattaaactcatttgctattgtatgttaccttgtgttattttttgcatctttgtttatatagattttgtttccctaagtagcccaaatatttgagagtggtcctaccattgacctttgaaaccccagcaatcaatacagtccctatacataatgtagtgccaataataatgtgctaagtatgtaattttttttctactgcttttagttttttgcacaacctaccctacggaaaaaattaaacacgccctctttcccacttcaactaaactttttgttttcttttttccatgtttcctaacgatcttgatgagcaatcaacaaatatacattgaacactctctccctgccaggtgtcaggttaagcactgaggatcaaggtcaaccagacaggtataataccagtcttcactgaacttacactctggtgaaggaagtaggtaaaaattaaaaagcgaataaaataattgcaagaattattaagtgtcttgaaagacataaaggaactactttcaaacaattcatttgtaatacaattggtaaaattatgacaggtcagggcagccctctgtgtagactataagataagctaaattggagaaaggcagagggagtcattacatttgcataagcatacagtttgtataattttaatcctgtgtagtttcaactttactatattttttaatgagccttgttaactttagattttaagtcaagctataaaatatatataactgaaccttacatacctgagtccctctactgctgattttgggaagaaaaaataaacttccacatcttcagatttctcaggaatcgggcaccccgcaccatagcccttacttgtgaggagtagacttcaagaagtaagtgggtgcatgtgaacgcgcaggcagactaaaggctacaaaaggggatgaaatatggtttctcagggtgccaaatttttcataaggtgcaaatgacttcaaaggataaaaggggctagtatttgaaagggtcgggctgcagaaggggtacaactgatgaagtccccaatttcactgtctggggttcactcttgattcatttatccattagcattttgggctgggaagtctttggtgtataccaaaggctttcaactcctgaggccagggccccgtcctgctgcctgcaggcctggcactatgtcagcctatggcaggggctcagcaaacacttgctgggccggtgcctccagctccacccgagctgagtctgcttcccagccgcgctgcccgctctgctccccgcaccaactagcccgggcttgctgcccgctaggcggactcagagaccatcctcccctctcatccacccgcagacagacaacccacctggagaccccagcctctcgcgtcaccaccgccggat

SEQ ID NO: 1101 - DNA, 140009 bp, Homo sapiens; identical to SEQ ID NO: 1099

SEQ ID NO: 1102 - DNA, 4817 bp, Homo sapiens
caaagctctaagtatgctgggacagatactacaaatgaactttatgatgagcgaattaacctgatttatagtcctgtactttctctacgtgccatatccattattaaagaaatgagtctaagtaggaagtagagttaacctatagtttcatttcttgaatttcttattctctttcttcagtctttttcagttaacctacacacacacacacacacacacacacacacacacacatatgtttataagtgggatgggagaacgggtacggtgataattaaaagaggtaaggtttctcttgagatgaaaatgttctaaaattgtgatggcggatgcacacctctgaatatattaaaagccattgaaatgaaaaaagggtggggggaatccaaaagtgtagcagacccaaccttgagatttgcttgtttgggaatgaattttccaataacttgaaagttgtaaaaactcacacttctcagggttaggtgtcagaaagaaaaggaagtaatttattctttaataaagcaattgttaaatactctttagaactaccactgattgcaattttgcagtgtctactcatagtgtctatataggtaccatgaaaaagatgtacttgtgaaactgttctcatgttacttcagaaaaattttgcttctaagtgtgtattctatgtctggttaaatgttcattgaattttatttaatcattaatctcaacagcattaaacagtcaataacataaatgacagtcttctctttgtactcctccctgtacaacatcacagagctccatctgtatacacgaaagtcacatgaaaatagaactcagtgttttgtattacatagtctattcagtacatttagaagtattttgcctccaatattcaaccacagtaaaagactcagtgagaacgcgtggtggcgctgcaggttaagatgacggaaaatacaactgcctacgcagctccaggatccagcaaaccgtttcccaaagcctggaagcaaaagaatagctgagccagagcgaacgtgagtgtgaaacctctttaagacaccgttgggctgcttggttctgacattctggactgcaaaacagttctactaggatcctggggatacatgaagcttctgtgaaccaacttttcaagaaaaagcaatggagattggatggatgcacaatcggagacaaaggcaagtccttgttttctttgttttgctgagcttgtctggggcgggcgccgagttggggtcctattccgtagtggaagaaacggagagaggctcttttgtggcaaatctaggaaaagacctggggttggggttgacagagatgtccacccgcaaggccaggatcatttcccaggggaacaaacagcatttgcagctcaaggctcaaactggggatttgctcataaatgagaagctagatcgagaggagctatgcggtcccactgagccttgcatactacatttccaagtgttaatggaaaaccctttagaaatatttcaggctgaactgagggtgatagatataaatgaccattctcccatgttcactgaaaaggaaatgattctaaaaataccggaaaacagtcctctaggaactgagttccctctgaatcatgctttggacttggacgtaggaagcaataatgttcaaaactataaaatcagcccaagctctcatttccgggttctaatccatgaattcagagatggcaggaaataccctgagctagtgttggataaagagctggatcgggaggaggagcctcaactaagattaaccctgacagcgctggatggtggctctccaccgcgatctggaactgctcaggtccgtattgaagtggtggacatcaatgataacgctcctgagtttgagcagcccatctacaaagtgcagattccagagaacagtcctcttggctccctggttgccaccgtctccgccagggatttagacggcggagccaatggaaaaatatcatacacactctttcagccttcggaggatattagtaaaactttggaggtaaatcctatgacaggggaagttcgactgagaaagcaagtagatttcgaaatggttacgtcttatgaagtgcgcatcaaagccacagatgggggaggtctttcaggaaagtgcactcttctcctgcaggtggtggacgtgaatgacaatcccccacaggtgaccatgtctgcactcaccagccccatcccagagaactcgcctgagatagtagttgctgttttcagcgtttcagatcctgactccggaaacaatgggaagacgatttcctccatccaggaagaccttccctttcttctaaaaccttcagtcaagaacttttacaccttggtaacggagagagcactcgacagagaagcaagagctgaatataatatcaccctcaccgtcacagatatggggactccaaggctgaaaacggagcacaacataacagtgcagatatcagatgtcaatgataacgcccccactttcacccaaacctcctacaccctgttcgtccgcgagaacaacagccccgccctgcacatcggcagcgtcagcgccacagacagagactcaggcaccaacgcccaggtcacctactcgctgctgccgccccaggacccgcacctgcccctcgcctccctggtctccatcaacgcagacaacggccacctgttcgccctcaggtcgctggactacgaggccctgcgggagttcgagttccgcgtgagcgccacagaccgcggctccccggctttgagcagcgaggcgctggtgcgcgtgctggtgctggacgccaacgacaactcgcccttcgtgctgtacccgctgcagaacggctccgcgccctgcactgagctggtgccccgggcggccgagccgggctacctggtgaccaaggtggtggcggtggacggcgactcgggccagaatgcctggctgtcgtaccagctgctcaaggccacggagcccgggctgttcggtgtgtgggcgcacaatggcgaggtgcgcaccgccaggctgctgagcgagcgcgacgcagccaagcagaggctggtggtgctggtcaaggacaatggcgagcctccgcgctcggccaccgccacgctgcacgtgctcctggtggacggcttctcccagcccttcctgccgctcccagaggcggcccccggccagacccaggccaactcgctcactgtctacctggtggtggcgttggcctcggtgtcgtcgctcttcctcttttcggtgctcctgttcgtggcggtgcggctgtgcaggaggagcagggcggcctcggtgggccgctgctcgatgcctgagggcccctttccagggcgtctggtggacgtaagcggcaccgggaccctgtcccagagctaccaatacgaggtgtgtctgacaggaggctcagaaacaagtgagttcaagttcctgaagccgattatccccaacttctctccttagggcactaggaaagaaatagattaaaattccacccttcacaatagctttggatttaattattgataggaacccatttgataaattccttaacttcttatgattgtcttgttgattaaattgttcatgctcaccaccaccaataaggtatttttctctgattgttagttcaaattatattgttaattccagtttcccttttcctcatatttaccccgaagaggtgttgcatatagaatcccaattaacaaaatatactttatcttcaaagttgatgtcatttaaaatttttccgtctttatattttatttacttcctattcattttttgctccatttttcatgttacttctcagtttcctagaacttcaagtattaaaataacctgttgcatgtattaggcatatttcctatgttacatttcttttgtctattttcctttcaaaattggtatttttgttgggctcaattttcattataatacttttcttaaagtttctttctttcttttcttttctttctttttttttttttcctttttgagacagggtcttactcttgtcacccaggctggagtgcagtggcacaatcttggctcactgcaacctctgcctcctgggctcaacggatccttccacctcagcctcccaagtagcttggactataggtgcatgccaccatgcctggctaatcttttgcagcgatgagattttgccaagttgcccaggctgatcttgaactcctgggctcaagccatcctccctcctcagcctcccaaaattctgggattacaggcataagccaatgtgcccatccaaagttttatttatttatttttttgagatggagtctcgtaaagttacctttaaaaaaaaagttctattttccctgtattggtatctccttaaataaaataaaatattcctattgtaagtgatatgagaaatctttaaccagccttatctaaaaataaaaagagaagccattgtaagacattcagtatgtgtaaatgtgtttgtgtttgtagacaaaaggcaaaggtattatgtaaaaatatttaataatttattctttctattactgaattaaaaaatcagaggtccctgttatatttttaatggctaacaactcaatctcattaagttggaaaaaaaacttatcaaagagacatttacatggtttggcttttatattcatcatagtatacattggcggtatctagccctttctctgtaaaatatccctatgtttaatctgtatttcttgcttattatatgtaaagttgagcttctttctagatattaggcctttgaataaaattctatgtgagtcaga

SEQ ID NO: 1103 - DNA, 2592 bp, Homo sapiens
aaaaagcagcagaacctggaagtccacggggagcttggatgccaaagggaggacggctgggtcctctggagaggactactcactggcatatttctgaggtatctgtagaaaaccacagcctcagatactggggactttacagtcccacagaaccgtcctcccaggaagctgaattcagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactgcgtttcctctgaagaatgctgaagacttagatataggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacattgaagttgtcgatgtcaatgataatgcccctgaatttgagcagcctttctatagggtgcagatctctgaggacagtccaataagcttcctggttgtgaaggtctctgccacggatgtagacacaggagtcaacggagagatttcctattcacttttccaagcttcagatgagataagcaaaacttttaaggtcgatttcttgacaggagaaattcgactaaagaaacaacttgatttcgaaaaatttcagtcctatgaagtcaatatcgaggcgagagatgctggaggcttttctggaaaatgcaccgttctgattcaagtgatagatgtgaacgaccatgccccagaagttaccatgtctgcatttaccagcccaatacctgagaatgcgcctgaaactgtggttgcacttttcagtgtttcagaccttgattcaggagaaaatgggaaaataagttgctccattcaggaggatctacccttcctcctgaaatcttctgtggggaacttttacaccctactaacagagacaccactagacagagaaagcagagccgagtacaacgtcactatcaccgtcactgacttagggacacccaggctgacaacacatctcaatatgaccgtgctggtgtcggacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaggatccgcacctgcccctcgcctccctggtctccatcaacacagacaacggccacctgttcgccctcaggtcgctggactacgaggccctgcaggcgttcgagttccgggtgggcgcttcagaccgcggctccccggctttgagcagcgaggcgctggtgcgcgtgctggtgctggacgccaacgacaactcgcccttcgtgctgtacccgctgcagaatggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggcgaggtgcgcaccgccaggctgctgagcgagcgcgacgcggccaagcagaggctggtggtgctggtcaaggacaatggcgagcctccgtgctcggccaccgccacgctgcacttgctcctggtggacggcttctcccagccctacctgccgcttccggaggctgccccagcccagggccaggccgactctctcaccgtctacctggtggtggcgttggcctcggtgtcttcgctcttcctcttctcggtgctcctgttcgtggcggtgctgctgtgtaggaggagcagggcggcctcggtgggtcgctgctcagtgcctgagggcccctttccagggcatctggtggacgtgaggggcaccgggagcctgtctcagaactatcagtacgaggtgtgcctggcaggaggctcagggacgaatgagttccagttcctgaaaccagtattacctaatattcagggccattcttttgggccagaaatggaacaaaactctaactttaggaatggctttggtttcagccttcagttaaagtaa

SEQ ID NO: 1104 - DNA, 855373 bp, Homo sapiens
agttggcgcgggccgcgggcgaggcggggccgcgcgcggggtcccctcctcctcccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagtaagtgccttcgccggaccccgaacctccagccctgcctcgctcccgtcgcggccttccccgcccccctcgcggcctcccccgcccccgtcgctgcctctgatcccccggccgtgagtgaacctcagcgcgcggcgggagcgggcgagagtggggcccgcgccgcgccccctccagccccggggcgccccgggagagctcgggcccgcgcggagccctgaccaacggggagctaggcatttctcgagcgttccagatgtccgcagcgacttctgatccgctgctcagcacgaacattttcacaatcagttatgatgcccagcaccattttcttgggataatatttaaaaatcagaaattgtccaagttacttatgaaatacatgcgcattgtgaaaaattcacaaaagtgtaaaggttcagttatgatctatgagtgcctctctctttccccatcctcttctctctagaggtgaccccttctaacatttatttagtcatcatagtgatgttaataagtagagtttatgatggacttgctaagtgccaaacactcttctaagcgctttatgtcaattttctcatttattccctacaacaactctgtgagttgctagaattattatgctggatttacggagagaaatcgaggcgatacattgaagtaacttggccaggattacacagtagtaagggccgagttatgattccaaatcagctggcacattctggagccagtacacactccagaatgtgtacttttaacgaatttgctgtgttgtatttgctaggacaatcttgaattgagaaatacaaaggtgactttaggttagatagaaggacgtttttatgtggtgaggataatggatttttttctgatcggttaattcactgtcagcttttgtgcgggaacatcgctttggcttgtttgaagctcaaggagcctaagaagtttgcttgctaaggtgaaggtactttcttcgtactggttggtgtttattacattcttgcctgatataaaaagcaatgggtcacagtgtaggggagtagcaaaagtcacttaatattggggcaggcttctaacaacatgcaggtaacagtcattaagaaagtcagcttcttagtcttctagatacttaatatgaagtttgctggctggtttgtggctcttgaatattgtagattactgatattgttaggctgatagccaaaatctaggtgaaatttctcttgggctctaaggcaaaggtaagactggttcaccttattaatgtattctaggacaatttcctggaattttaaacacagcatactttcctttttttttttttaaaaaaaaacttactattactgattaaaataaatgtcccttaaaactcaatgtaaaaatgtatatttttaaaatggcactttaaaattttaggtagagtctatgatttaaattaactagtaggttttggaagtgaaatcttaaagtgaagttttatgaaacttatgcaataggttgaaatttttctagggtttatactttaaaggtagtatagtaatgtagttttaaaaatactttttaaaaaaattaggagagatgctgattaaaagtttaaaaagtgtttcaagatgaggaaagagatcttaatgaattctgcttgttagttgtttttttttgcttgtgttcttaaacgtttgctatgacagtagaattcagcgtctttacctagcaagagagaattttgaacatgtaaactggtagtcagcagtgaaaaagcctcatccattttttacattttttttacataaatagggagagtgcctgatttatatgtagggatattggcttttgtgtgggtgggtttgctccgtttgtctaaagaggacaaaatttgctgcagtcctgagaagcttcattttaaagtagcggaacttgttaatcagctggatcagcagcctgtgacctcactagcagatgttgtcccagttaaaaagatcacagatcaagttaaaactagcttaaataacattgagaggtggtgttcataaacaaaatacattagtgagtagaagaagaatagatatttgatgtagatattgttaaataacaataaatcctgagctaatcactgagtattcatcttttccttggaagctattatttcctaggactcattgtactctattgggtaaatgcttttgcatttctctgtggaatacaagctattaattagagtaaatataactggtgtaacgatctgtgtttttattatgtatactcttggggataaagaacacattggtatttaatgttaaagagaaggattatgtatagtagaaaagaattcttcttggtaaagtacatgcaaataaacctatgaaaggtttatttgaagatagtagcttgttttacctggcatttgaagtaataacacagtgggaaaggctttaactagaaaatctcacttcactaactatcttgaaaatctttttctaaactgaaggatagcaaccttacaaacagacattaaaaatgattgatcaatcttggtaagcaggtgtcaaaattaattggttggctccatggtaacttagctttttttctactatagggatttcgccagggaataaaaatgttcttcaaatgtttcttgaggatagaagattgatagttgggggaagaaatgcagaagcaaatatagtatcaaaagtggtacttcagttctcttagcattgattccagtcttctgttttcatttgaaaagaataaagcactcagaataacaagccattccttccttacacaggtaaaacaaaaggaacattgatttttcacccaaagctagactaaaggacttgggattgagaataggaaaatatatttgaaatataataatcaaagatacagactctaattcaagttgtatttatttgaatagttcagtgtaatgttaagcaagaaaatattctgctataatctatttgaatgacgttctcttttagaagggagcccttgagaattaattttgtagagtagagatttatataaatttatataaatataaagagtattgctctttatattagtcaaatataaaggggtatatttttacccctcttaggttagtcaaatttggatacttcatttcacgcatttaaaatggaagtatgctgggtgccgtggctcaggcctgtaatcccagcactttgggaggccgaggtggaaggatcccttgagcccagaagtttgagaccagtctgggcaagatagtgagacctcatctctacaaaaaatattttaaaagtagctgggcatggtggcacacacctgtggtcacagctacaagagagagtgaggcggaagaattccttgagctcaggaggttgaggctgcagtgagctgtaatcacgccactgcgctccagcttgggtatcagagcgagactcttcttaaaaatttatatatacatatatgaagcattctatttgtagtgacagcaaaatgaagatgtaatgatataatgtcaggaattaggttgttattatagacaaaaacgggcagaataaagtgtgtaaactcttcccctaagctgttaaaaatatatgcatattgcctggcttggtgtctcacgcctgtaatcccaactctttgggagaccgaggcgggcggatcatgaggtcaggagatcgagaccatcctagctaacacagtgaaaccccgtctctactaaaaatacaaaaattagctgggtgtgatggcacgcacctgtagtcccagttactcaggaggctgaggcaggagaatcacttgaacccaggaggcggaggttgcagtgagcataggtcgcgcaactgcactccagcctgggcaacagagcgagactccgtctcaaaacaaaacaaaaataaacaacaacaacaaaaaacaaatatatatatatgcatatgtaaatacatatatatttggaatcctttttacttgtaaggaaactgacagtaattataaacttaaactgaatgttccctgtccctaagacttctttatttcaaagttttattttaatggataatttatatccatggattatttttacattattaaagtgtataatcacacagtaggaatttaaaataatttaaattgagtgtttcttagattctaaattgataaggtaagttacttgtagaagcatagtagcatggttttcaagaacacgtgtctgcatgatttggcccctttagctgattagactcaggcctcctttcctctgccctgactggccttttgaagttccttgaaagtgtcacattccttttggccttagtgcattttatacacgtaactgtgaactctttcctctctggtctttgcttgggtgattactgatcatccttctaatcttagcttaaatactagtttcttttttttttttttttttttttttttttgagaccgagtctggctctgtcacccaggctggagtgcagtggcgcaatctcggctcactgcaagctccgcttcctgggttcacgccattctcctgcctcagcctcccgagtagctgggactacaggcgcccgccactacgcccggctaattttttgtttagtagagacggggtatcaccgtgttagccaggatggtctcgatctcctgacctcgtgatccacccgcctcggcctcctaaagtgctgggattacaggcgtgagccactgcgcctggccacttaaatactagtttctaaaggaggcttgtctgactcttcacactaggttaccccttatatactgccctaatagcactatttttccttcttagtattgtcaaaaatgaggtgtttaattataattttgatagttatttaaacaaaatttttaagagattgaggtataattgtcaaacagcacaatttaaaatgtacaatttatttaaattatacaatttgataagttttgtcatatgtatttgcatctgaaactgtcaccacaatcaaaatcatgaaaataccaatcacgctagaaagtttccatgtgtttcctttgtaaaccctcccttttctagttgccaattcctgtcccagggcaactattgatctgctttctctcactatagatttgttggtattttctagaactttttgtaaatagaatcatacattatatacttcttttttgtctggcttctttcacacagcgtgtttattttgagattcattcatggtgtgttagtagtttattctactgccgaatagtgttccagtgtctggatacaccataatttgtttatccattcaactgctgatggacatttggattgtttcaaatttttggctgttccttataaagctgctacgaagtttcatgtggaaggctttttatctttgtatggtcatatgctttcctttctcttggggaaataacctgagaatggctggatcatatgggtagatatatgtgtaactgttaaagaaaccgacaaactgttttccaaagtagttgtatcatttatgttcccaccagcagtgagtcagtgttctatctagttaatttcacatccataccaatacttggtatggttagtcttttaaatttttgtgattctaataagtgaatggtatattattgggttttagtttgcatttcccgaattactaatgatattgagtatcttctcatgtgcttacttgccatccgtatatcttctgtaataggcatttattcaaaccttttgcatgttaaaaaaattttcttactgatttttgtgagttctttacattttctggattactagcttcttatgaggtatatcatttgcatatattttctaccagtctgcggcttgtctatgaaaacaatgcaaagagaatgaaatctcttgacagtatttttcaaagaatctaagttttaaattgattaattccagtttatcatttttttcttttatacttttcatgttgtgcctaagaaaagtttgcctaggctgggtactgtggctcatgtgtgtaatcccagcgctttgggagcctgagacaggaggatcacttgagtctaggaatttgagtgcagcctgggaaacaaggcaagacactgcctatacaaaaacatttgaaaaattagctggtcgtggcggtgtgcgcatttagcccatctacttggaaggctgagatgggaggatcactttaacacaggaattggaggctgcagtgagctgagctgtgattgtgtcactgtactccatcctgggcaacacagcaagaccatgtctttaaaaaataaaaaataaaaaaaaaaagaaaactgcctaaaccaagttgatgaagattttcttcattttttttctctagaagttttgtaattttagattttacatttatatttatggtccattttaagttaatttctatatatggggagaggtatggatctaaattcagttttttggcatataggtatttgttttagcactatttgttgagaagagtattctttctctgttaaagtagctttgcacctttgttgaaaccattcatatatttgtgtttctatttctggactctgctttgtttcttgatctctttgtctatttgtatgtcagtacaacaatgtcttgattattgtttctttgtaagtcttgaattctgggagtgtttttcagttttgttcttttccaattattttggctactctgagtcctttgtatttccatatgaattttagaatcagcttgtcagtttctataaaaagcctactaggattttgtttgtaattatgttgagtctatagatcaattttggggaaaatgaataccttgtcagttttgagtttcctacatggtatatctgtttatttatttagttgtttaatctgtcagcagtgtttttaaatttctagtcaatagatcttgcacctcttttgtcagatttttccctaagtagttaatatttttggatgctattgtaaatggcattttttaaactttcacttttgattgttgctattatactgaaacacaactgatttgtgtatgtttgattttttatcttgcaatcttgccaaacttacttattacttgtggtagatttttgcagattccttatggctttctacttagatgattatattgtttacagacaaagatatatttacttctttctttacaatctagatgcctttttttttcttgccttatttcactggccagaacctctattacagtaatgaatagaggtgatgagagtggtcaatcttacttaagatttagggggagatatttgatctttaaccatgaagtatgatgttatctgtaagttttttttttagatgccttttatcacactgagaaagttcccttctattcctagtttgccaagagtttttaccagtgatggaaactggattgtattaaatgcattttctgtgcccattgagataatcatatgattttttcaagtttgttaacatggtgaattatgtacataatttttgaatgttaaaccaaccttacattcctaagataaacttcctctgacacaatatgctttcctttttattttaggttggatttggtttgttaaagttttatttagaatttttgtatctgtgttcatgagagatattagtctgcacttttcttataatatatgactagttttggtgacaagataatgctggcctcatataatgagcaccatgggactctcctgatcatttgctgaaagagtttttagggaattggcattatttcttcattagtgtttggtggaattcaccatcgacaccctctaggcctgaagttttctttaactccaaattcaacttttattaatatacattcaacttatttaatatacagaaggctatatgactagaatcctttaaaatttattggccagaatattgtctatcttggttaagtatttttttgggcgtgtgaaaataatgtgtattcttctattgatgggtggagtgttgtatacatttcagttaggtcaacttggttgatagtcttgttcaagtcttctacaaccattctgattttctgtctgtttttaccacttattgagagaagggtatcttcagttataattttgtatttacctgtttgtccctgcagtcttatctgtttatccttcatgtattttgaaactatgttattaggtgcataaaattttggattatgtcctcctgataaactgagcctttatcgttatccaatgaccatttgttgaaaagactatccttttttcattaatgtctttgtacctttattgaaagttaattggacgtctttatgtatatttattttttgactcttttctgttccattgatccatatctctatccttttgcaaattcctcactttattaatgtatgtatgtactttattaatgtatgtatatgtgtatatatatatatacatacatatatttgagatggagtctcactctgttgcccaggctggagtgcagtggcatggtatcagctcactgaaatctctgctcgtcaggttcaagcggttctcctgcctcagcctcttgagcagctgggattacaagcatgtgccacctcacctggctaatttttgtatttttggtagagatgaggttttgccatgttggccaggctggtggtctctaactcctgacctcaggtgatccacccacctcggcctcccaaaatgctaggattagtatatttttacagtaaatcttgaagttagataatgagattcccccaactttatttttatttttgaaaatttacttggttcattttgtttttcatatacattttagaactgtttgtcaattaaaaaagtcttgctgggatttttattgagattgtgttgacttagtaaatcattttgaggagaattgatatgtaaataatattgaattatctcgttcttcattgcagtatgtttttttcatctatttgggttttcattgattttttacaacagttttttgtagttatcagatacagattctgtgtatatatttttagtgttttttttttttttttgagatggagtcatgctctgtcactcaggctggagtgcaatggcatgatctcggctcaatgcaacccctgcttcctgggttcacgcgattctcgtgcctcagcctcctgagtagctgggattacgggcgcccatcatcacgcctggctgattttttgtattttttgtagagatggggtttcgccatgttggctaggctggtctcgaacttctgacctcaggcaatccgcctgcctcagcctcccaaagtgctgggattacagatgtgagccactgcgcctggtcatattttttgattttataccaaaatattttatgttctttaaggctattgtagttggtagtatttcttttaatttcaatttccagtttgtagactttaaaaaaataatcagggaaatctttctttggtgatatttcctcgcccatatctctttattttttatttttgtggttacgttataggtgtatatatttatgggataaatgagatattttgatacaggtatacaatgcctaataaccacatcagggtaaatagggtattcattacctcaagcatttatcctttctttgtgttataaacaattcatactaattatactttctacccattaaccatccccatttcccccactccaatacctttcccagcctcaggtaaccatcattctactctatctccatgaattcaactattttaatttttagctcccagaaataactgagaaaatgcaatgtttgtctttctgtgcctggcttatttcatgtaatgtaatgatgtccagttccatccatgttgttgtgaatgacaggatatcattcttttttatggctgaatagtactcccttgtgtatatgtaccacagtttatttatccattcatttcttgatggacattttggttgcttccaaattttggctgttgtgaatagagctgcagaaaacattgaagtacagctgtctcttcaatatactgatttcctttcttttaggtaaatacctagcagtgggattgctgaatcatatggtagctctatttttaattttttgaggaacctgcaaactgttctgcatagtagttacactaatttaccttcccaccaacaatgtaagagggttcccttttctctatatccttgccagcatttgtttctgtctgccttttggatatgagctatttaactggagtgagataatatcacattgtagttttgattttcatttctctgatgatcagtgatgttgagcatctttttatttaccttttgacattggtatgtcttcttttgagaaatgtctattcagatcttttgcatatttttgaattggattattagattttttttcttacagcattgtttgagcttattatataatctggttattaatcccttgtcagaatgatagtttgcaaatattttcttccattctgtggatcgtctcttcatgttgttgattgtttcctttgctgtgcagaaactttttaactcgatatgatcccatttatccatttttgctttggttgcctgtacttgtggggtattactcaagaaatctttgcctagtctccaggtgtcctggagagttttcccaatgttgtagtagtttcatagtttgaggtcttagatttctaagtctttaatccattttcatttgattgttgtatatggtgagagataggggtccagcttcattattcttcatatggatatccagtattcccagcacaatttattgaggagactgttacttccccagtgtatgtgcttgacacctttgtcaaaaatgagttcactgtaagtatggatttattctgggttccctattctgtaattgctctatgtgtcctttttttttctcttttttttaatgccagtaccatgctgctttggttactatagctctgtggtataatttaaagtcaggtaatatgatgcttccagtattgctctttttgcttagaatggctttggctattctgggtctttttggctctgcatacattttatgattttttttctatttttgtgaaaaatgtcattggcattttgatagggattgccttgaatctgtagattgttttggatagtatggacattttaacaatattgattcttccaatccatgagcatgaaatatctttccattttttttggtgtcttcttcaatttctttcatttttcccctgcctagaggtttgtggaactttgaacttcagcgagatgatttaaggtatctggcagaagaaatttctaagcagcaaagcattcaagatgtgacttgggtgctgttaaaggcattccattctcaaagggaaacagagcataaaaatttgggaaatgtacagcctgacaatgatagaaaagaaaatcccattttctgaggagaaatttaagccagctgcagaaatttgcatgagtaacgagaagccaaatgttaatttccaagacaatggggaaaatgtccccaggccacgtcagagatcttcggggcagcccctctcatcacaggcctggaggcataggaggaaaaaatggttttgtgggccaggcccagggttcctgtgctgtatgcagcctagggacttggtgtcccttgtcccagctgctctagctatgactaaaaggggccaaggtgcagctcaggctgtggcttcagagggtgcaagctccaagccttggcagcttccatgtggtgttgagcctgcgggtgcacaggagtcaagaatcgaggtttgggaacctctgtctgcatttcagaagatttatggaaacgcctggatgtccaggcagaagtttgctgcaggggtgggactctcatggagaacctttgtatgtcagtgtggaagggaaaagtggggttggagcccccacacagagtccctactggaacattgcctagtggagctgtgagaagagggccactgtcctgcagaccccagaacagtagatgctcctacaccttgcaccatgtgcctggaaaagccgcagatgttcaacgacagcccatgaaagcagccaggatgaggctgtactctgcaaagccacagggtcggagctgcccaagaccatgggaacccacctcttgcatcagcatgacctagatgtgagacctggagtcaaaggagatcattttggagctttaaaatttgactaccctgttggatttcggacttgcataggccctgtaacccctttgttttggccaatttctcccatttggaatggctgtatttatccaatacctatacccccattgtatctaggaagtaactagcttgcttttgattttacaggctcataaatggaaaaaacttgccttgtctcagatgagaccttgggggtgctgaaatgagttaagactttgggggactgttgggaaagcatcatttgttttgaaatgtgaggacatgagatttggaggggccaggggcagaatgatatggtttggctgtgttcccattcaagcctcagtttgaattgtatctcctagaattttttgatgtgttatgtaaaggaattacccagcgggaggtaattgaatcatgggggccagtctttcccgtgctattctcgtgatagtgagtaagtctcaacaatatctgctgggtttatcaggtgtttctgcttttgcttcttcctcatttttctcttgccactgccatgtaagaagtgcctttcacctcccaccatgattctgaggcctccccagccatgtggaactgtaagtctggttaaatctccttttcttcccagttttgggtgtgtctttatcagcagtgtgaaaatggactaatacacttggtaatttataatgaatagagatatattggctcatgattctggaggctgggaagtctaagatcaagaggctgacatcttgtaagggctttcttgctgcatcatcctgtggcagagggtaaatagagggtcaagggataggcaaaagcattcaaatctcatccttttataaggaacccattcccctgataatgaactcactcctgaggtaacagcgttaatgccctcatggtttaatcacctcccattatgccccacctctcaacactaatccagagccttcactcagtccagcaccaactcaaaagtccaaagtctagggtctcttctaaatcagatgtaggtgagactcaaggcacaattcatcctggggcaaattcccttccagctgtgagcctgtgaaatcaaaacaagttgtttacttccaaagtgcaatggtgagacaggtataggatctacattcccgttccaaaagaaaaaaaggggtaacaggccccaaataagtccagaacccaacagaacaaacaatgttaaatctgaaagctagagaataatcttttttgactttatgtttcgccttctgagcatacttggatgaggattgggctcccaagacctcaggcagcccagcccttaggctttgctgggctgagcctacatagcagctctcatgggttggaggctcatgcctgccgctcttatagtctgaggctgcacatgggtgactctatagttctgaggtctcagaggcagccctgctcccatggccctattaggcattgctctagcaagtactttatgatgagtctgctgctgtagcatcctttcagatctacattgaggtagccgcatctccacaacttgtgcagtctgtgcacctgcagaattggcaccacatggatggataccaccaaggtttatttcctatacttttcagagctgcagccagagacacaccctggtttgcttgaacagtgactggggaggctaagggaagctgtgccagaatgcagggagcagatacttgaggcagcacagggcagtgaatgctgaggtcccatagatgcctttctggaaactgtgatctcaggatcctagatgggaggggcagcccaggagacctctgaaatgccttcaagatctctttctatcttgatgaatagcacgtgacttccttttatccatgctaatccccttatgcaagggttccttggccacacccttgcatgctttgcttttttgttctttacatatacaaactgtgacttttccaaatcattactttctgcttcccttttcataatatgttttgtttttaaatcattctaccttctcgcatctttactatatgcagttaaaagtagccacgcagctctttcaatattttgcttagaaatttcttccaccagatatcctagtgaagtggctacattgtctggggtatataccctggggttcatcatcatgcaccaggaaaatttagggcatggacacacacaaggggtttaggagtagaggtttaataggtagaagataagagaaggagaaacagcctcctttataaagggaggggtctctgatcggaaaggactggctggtggcaaatgtgccgagttttatagtccagtttgaggaggcagtgtctgatttctgtaggggtcacagattggttagatcaggtatgaagtttacatagtgcatggggaaggctggttgccccaccataatcttcttatgaaaatggatttcccagttgatcagcatcatcttgtctgctccttacaatacacatggctggcagagaagagaggatggagccaccattttgaaaatgtctagtccttagttcctgtcagcattcacccatgcaagctctcagcttgcaggctgctccttgttagaaaatgatttggggctgcttttcattgaaaaggaaagccttaccaagcactcccatgcccttgttctctgactaagtaattcctttctaactcccattatactagcttattgctcttaaattctgccttccatgaagcactcagatatgggcacaattcagccaagttatttgctgcttcatgtcaaggatggctattactccagtttgcagtatctctttcctcctttctgtctgagatctcctcagagttccctttactctccacatttctgccaatattctgatcataagcactaatgtaatctctacaaagttttaggctttccctgcagttctcttctgagccctcatcagaatcatccttaatgttcttttcataccaatacaagttttttctagccttttttttttcccaaactctcccagcctctacttattgctgagtttcaaagtggcttccctattttcagatatttgataaagcagtgttctatgcttcaataccagttttttgtgttattcagttttgtgctgctataacagaatacttgagacctagtgatttataatgaataaaaatttattggcttatgattctgttgggaaggccaagattgaggggccagaatttggcaagagctttcttgttgcatcattgcatgacagaagagcaaagagagggtgaagagagaaagagaggagggcaaaagggggtgaaatcatccttttataaggaactcattcctgcaataacagcattaatccattcatgagggctatgctctcatggcctaatcatctctcattaggttccacatccccacactgttgtatcggggattaagttttcaacacttttttggagggacacattcaaaccatagcagagactctgcttcatgtcaaggatggctgttattccagtttgcaatatctctttcctcctttctgtctgagatctcctcagaattgcctcacaattaaatattctgttttaggaggcaatcaacttgttttggttcagcacacatgacctagctcacttttcaaaaaacagagctttactgagttacaatttgcacctcaccatattcaccttttaaagatgtacagttcacttatgtttagcatatttagagagtggtacaaccatcaccattacctaattttaggctgaagagccaaattgtataaacaaattggtatctgtgacttgttaaaaaataatttctagggtatcttatatagtcagtataaaatcaaactaatctgtactttagatgtataaaaatgaatttttataatgatgttttatcataacatcattatatcagtattttaccatcctgagttatcaaagcatattataatttccaaaaatatagaaataaactgaggtaggcaaaactttaagatggcccttttgacttttatccctggtattactgtcatgattatgttatgtcatttgtcaagagggagattatttgggttttcttactctaatcacatgagccctttaaaagcagagtatttcccctgggtgctagcagaagaggaagctaaagactcaaagcataaactggatttgacatgctaatgcttgtttgaagatggagggagccatgcctgaaagtactagagaaagtggcctcttggtgctgagagcgagcaacccctggtcagcaactggcaagaaagttgggacctcattcatataactggaatgaactgaattctaccaacagtgaataagcctggaagtggatgcttttctggagcctctggataacagcctagctcaactaatacccatctgagtctatagggacttctgtcctatagaactgtgagataataaatggatgttcttttaaatttctatgtttatggtaatttgttaccagcagtaaaaacaaatttaggggcatatttagcaatacatcgttgaaaaaagttattctggctgaatttcaatgatactgagttaaccagaaaattaaattaattctttaaacatgatggtcaattgagttttattatctttaacagtaataatacaaggtgattgtcatttattaatttaagctttttataacaccttgtgtacctgtctttgatttctttggtctgccatgaatggttagaattaatgctcaaaatgtttgccataaggttactaattgctgtctggatccacgaaaggaagatgctctggcattttagatatctgatttatttgaccctatttgatgcacagtatacttccagtctaccatttgagccaaaaagtgaataggagaactattttacagatagcataaagttatgaaatgatcagtagatgtgatgaagtttagccaaaaggggaagagattgatcttatcattagatagtagattaatttgaaaataatgattaccatgtgcaagagaagtattccctgattaaaaaatgtttgagttgtatagttatctcagtagctgaagggaatgttgaggaaaaaatgtattaatgagctaaaatcttatttggaaatatccttgttagaattatagagctcagaatcagctgatgttgtagtccatttgtattgctacgaaggaatacttgacgctggataatgtgtaaggaaaagagatttgtttggctcatgattctgcaggatgtacaagaagcatggcaccagcatctgcttgtattgcggggctcaggctgcgtctactcatggcagaaggcaaatgggagctggtatctgcagatttcatatggcaggagaggaagcaaggggtgggagcggccaggccctttttcataaccaactctctcaggaactaatagagtgagaactcactctttactgtgaggatggccccaagccattcatgagggatctgcctccatgacccaaactcttctcagtaggcctcacctctgacattagggatcaaatttcagtgtaaggtttggaggagtcatatattcaaaccatagcagttgagaattaggcctcaaagtcagatagataatggttaaaatatcaactatatcaatactgaattggagaacatctttttcttgtgtggccataatgggctaatatttcacctcaaaattaaattacccactcatttatgggccaagttaggcaactgctgatctgtattgcaaggtaggacaacagtagtggaagatagtagtcagaatgcatttcctgtgcctaaaatagtctgacagtgaatgatctgataaagaagttaggaaaacagttccatttacaatagcatcaaaaaacaaaacaaaaaaaacccaaaaaaaaaacttacgataagtttaaccaaagaggtaaaagatctatatgtagaaaactagaaaacattaatgaaagaaattgaaggtgacacaagtaaatggaaagatactttgtgtattcatgaagtgaaagagtattgttaaaatgtctatattacccaaagtaatccacagattctatgcaatcctatcaaaatagaattagaaaaaaatcctataatttgtttgaaaccacaaaagaccacaaatagctaaagcactgttgagcaaaaagaacaaagctagaggcattacactagctgactggtctttgaaaagttaatggaaaatgcatattatgaaaaaactgcgtggatttcaaattttttttgcaccaaaacaaactcataccaaattgttataacaagtctgaatgggatcaagtttgaggcactaaggaggataagacattggtttgaaaagggcccctatcagagtaacataaattctgctaaaattgaagcaagagcaaacatcaaatttatggtgaagcttgggtggaagaaggtgaaattattgatgctttatgaaaagtttaggaggacaatgccccaaagtaatcagcagtttataaatgggtaactcattttaagaagggatgatatgatgttgaagatgaagcctgcagcaggagactattcacatcaatttgtgaggaaaaaatcatcttgttcattctctaattgaagaggactgatgtttgacagcagaagcaatagccaacaccatagacatctcaattaattcaacttactcaattctgaatgcaaattaaagttcagtaaactttccaatctatgggtgccaaaaccactcggaccagattaactagagataagagcagaggttttagtggaaattataaacaagtgggatcaagatcttgaagtatttcttggaagaattgtaacaggtgaagcatgactttaccactacaattctgaagacaaagcacaatcaaagcaatggctaccaggaggtagaaggggttcaatcaaagcaaaagtggactggtcaagagcgaaggtcatggcagcagttttttgggatgctaaaggcattttccttgttgactttctggatggccaaaatataacatctgcttattatgagagtgttttgagagttagccaaaactttagcagaaaaacacctgggaaagcttcaccagagagtccttcttcaccatgacaatgcttctgttcatttctttcatcaaacaagggcaattttgtgagagtttctatggaaaatcattaggcatccaccttatagtactgatttggctccttttgagttttgtttgtttgtttgtttcctaattgatatggtttggctgtgtccccacccaaatcttatcttgaattaccacgtgttgtgggagggatctggtgggagataattgaatcatggggccaagtctttcccatgctgttctcatgatagtgaataagtcttatgagatctgatggttttataaagaggaggtcccctgcacaagctctctctgcctgctgccatccatgtaagacatgacttgctcctccttgccttccaccatgattgtgcatgctccccagccacgtggaactgtaagtccattaaacctctttcttttgtaaattgcccagtctcaggtatgtctttatcagcagcatgaaaatggatgctaatacactaatcttaaaatgttttctaagggcacctatttttcttcagttgataatgtaaacaagactgcattgacatggttaaattcctaggaccttcagctctttagggatgtactaaatgactggtatcattgcttacaaaagcttcttgactttgatggaacttatgttgaaaaataaagtttatattttttatttttatctgtttttttttccatgaacttttagtcatctcatagttattaaaacagcgtgatacctgcataaaaacagacaaattgacccatggaacaggatagagagcccagaaataaattcacctgtctgctgtccactgattttcaacagaggctcgaggaatacacattggagaaaggacagtcttgtcaataagtgattctaaaaaactaggtatccagatatagaagaatgaaattaaacccttatctgatcccttatagaagaatcaactcaaaatggattaaagatttaaatggaagatctgaaactaaaacaactagaaggaaacataggagaaaagctatgactttggtctgagcaatgacttcttgcatgattccaaaagcacagacagcaaaagcaaaaatagacaaatggtattgaatcaagaagcttctatacatcaaaggaaataacagagtgaagagacaacctacacattgagagaaaatatttgcaaatcatacatcagataagggactcatacccaagacataaaatgaactcaaatcattcaataacaagaaaacaaataacccctatttaaacatgggcaaataatctgaatagacatttttcaaaagaaaacatacaaaaggtcaaaacatatatgaaaacatgctcaacattactaatcatcagggaaatgcagatgaaaaccacaatgggatgtcatctcatacctcttaaaatagctcttataaaaaagatgaaagataacgtgttggtgagtatatggcaaaaagggaagtttttgtacactattgggggaaagtaaattagtacagccattttgaaaaaaaatatggaggttcatcaaaaaactgaaaatagaatcaccatatgatccagcagtctgagtatatatccaaaggaattggaatcagtatgttggagagatgtttgcattcacatgttcattgcagcattgttcataatagccaatattgggaaacaacctaagtgcccaccaacggatcaatggattaaaaaaagaggtatatatacataatgaaatagtattcagcctataaagggacaaaatcctgtcatttgtgacaacatagatgaaactagaggccattaggttatgcaaaataagctaggcttagaaagacaaatatcacctgatctcacttacatgtggaatctaaaaatttgaatcaattgaagtagagagtagaatgggggttaccagaagctgtgggtggtggtcagttgggcagggaaaagaaaaatattggtcaaagggtgcaaagtttcaattaggaagaataagtgttctattatttcgttggcgttctattgtacaatgaagtgactaatgttactaattgtgcattgtgtatttcatatactacattgctaatagagtggattttaaatatttttgctgcaaaaaatatgtatgtggggtgatgggtatgttaattagcctgatctgctcagtctgcaatgtatacatgtattgaagcatcacattttaccccatgaatatatacaattattatttgtcaataaagatgaaatgaaaataaaaaggaattaataagctgataaatagtattttaactagaaaatctgtttttaaaaaagatttctatgtgaaaaaggcttacaaaggccaccctgcataaagactatccctgagtggatctgactattccttgtaggctggttatgccaggactaaacctatattctgtgataaacaggatttattgtttcagagatttcgtaaattaaaactatcacactttcttatttttataatgtgttaagttatatatccatagtcaaattatatatccatagtcaggatagacaacaacatcccactagatttaattttagtattgtctaatatttgtgctggttttcctgcatttattagtggccaaccttgtgttataaacagcccagcatgcttttaattaaggactctactttcagctagaatgagatattgacaaggcatatggatatgtggcaggcatctagacaagtgattggcaaactttttctggaaagggccagatagtagatattttaggctttgttggccagatggtctctgttgccagtactcaactctgtcctcgtagtgtgttagcaatcttagataatacttaaacaaactagtgtagttgtgttccaataaaagttcatttacacaaacaggctagtagtttatgtagtactgatctagatgaataagtcagtatggttctcagttcaagaagaggaatgatagaaagtttaaaaaaaagttgtttgaaacttggaatatgtattagaaataatattagaaatagtagttatgtaagagcctattttactttctttagggagttgaactatgtgctacctaatttctggagagcactacacaattggaatgtaagggtattaggagtaagaagtaaaaaaaaataaatggaaaactaggtgtttatggttagagtatggtcctggagtgcaagacttctgaattttagaagaacagttctagactgtaaagaggtccaaagtatgtaatgggaatgctttgcccaagtggcatgcaggtaaaggttcttggagtttaagaagagatcatgaaactgaagaaggagaattgttctttctttattatagaagtagcaggagatttctcccctttacgcatgtcttttggtggtgagaaggaattttccatttcttttaccttgattggtgacatcctcccatgcttccagtggactggtattggcaaggaggaaacctttttgtagtaagtggaggaaaaggtgggctcttggtaagatctttagtgctaaggataaggaattcagggattgtggtgagtagtttccttttaagtttgggaaattgtactactgaagttgaataggacgggacagggtgtgtagttttcaggtactcctattgtttagcttaggtagggaggcataacagttccttcacatcacttataagagggagataaggattactatggtagctcctacaatatatgtttctttggaggaagggggatatatatttttaatttttgtgggtacagagtaggtgtatatgtttatggggtatgtgggatattttgatacagtcatgcaatgcataatcacatcatggaagatagggtatttatctcaagcatgtatcctttgtgttacaaacaatccaattatactctcagttattttaaaatggacaattaaattattattgactatagtcaccctgttgtgctttcaaatactagtctcattcattcattcattctatttttttgtaccccttaaccatccctacctcctcctcactttaccactacccttcccagcctctggtaaccatcttcctactctctatctccatgggttcaattgttttgctttttagatcccacaaatcagtgagaacatataatgtttatctttctgtgcctggcttatttcacgaaacataatgacatccagttacatccgttttgttgcaaatgactgaatcacattatttttatggctgaatagtaattcattgtgtttatgtaccacatttctttatctgttcatctgttgatggacacgtaggttgcttccaaatcttggctattgtgaacagagctacaacaaacatgggagtgcagatatttcaatatattgatttcctttcttttgggtatatacccaacagtgggattgctgaatcgtatggtagctaaatttttacttttacgaggaacctccaaagtgttctccatagtggttgtactaatttacattcccacaaacagtataagagggttcccttttctccatatccttgccagcatttcttactacctgtcttttggatataagccattttaactggggtaagatgatatctcattttagttttgcttttcatttctgtgatgatcagtgatgttgagcaccttttcatgtacgtatttgaaatttgtatgtcttcttttgagaaatgtctgttcaaacctttagcccatttttaaaattggattgttggctttttttcctgttgagttgtttgagcactgtatatattctggttattaatcctttgtcagatggatagttcgtaaatattttctcccattctgtgggttgtctcttcatgttgctgtttcctttgctgtgcagaagttttttaacttgatgtgatcccatttgtccatttttgctttggttgtctgtgcttgtgggttattcctcaagaaatctttgcccagtccaatatcctggagagtttccccaatgttttcttgtagtagtttcatatgcttaactacctgttattatgctagacattttatttgaaaattattgatagaaataatttaaggcccaggataatgttatctttctttagagagtaccatgtatcttctgttaggagacttggcatattggcagttctggcagcaccataagccgattttaagacttgggagttttctgctgctcagatgactcatagctaacctacagttgaggtaaaggctggttaacttctggtacaccactattttaatagcaagtcattatgtcccaagtcaaagtgccctgttgtttctttgaacccctatgttttgtgggttattgcttccaacttttgtcctcctctccccttgaggctactaaatgcactctcaaccttttggcagtctcttctaaataagcaaatctctcagaacaaaagcatctctgaatgcctgcctcctcttaaagaatttgcaacttctggatcttggctttgtacattttatcattttgttacttgtaagattttaaaattgtcctttaactttttaagttgtcttcagtggagagtttttctgaattactgcacttagtattaatattattggaagtgaaaaatcagggcaagttatttaacttgttacttaaaatgtgcttcagacttctcatctgtaatatggagttattaattatttactatcttataggttttttgagatttttaaatgaggcaacacattgtgtttatagtggtacctgacatgtagaaaatgcttaagttattattacatttatttgagaatataggaatttgttgctcttcaaagattttccaagcatgaattagccactttattacaaaagtaatttgcagggattatgaaagatttgcaaatgacattaacattgactgacatttctgtcaaccctgatttaggtaaattaaagtttttcccccctaatgtatttaaggctctatactataaggaaaatttaattttatctaaaagtagataatggccctgatatgtatatgtgtgtgtgtgtatgtttatgtgaatatgtaaaaactgattagctgtgatgtgtgtgtgtttgcatatataagtatagtatataaatgttaaatgggaagacattttaattctttaaaatatggtctcttgataaaataattgggctggaagtaaaaaaaacaaaatgaagcagaattgagatttttgttttaaagatttttaatttctgaaaatagagtttttccaaatatctttttcttttttatgcataaaatagaagatacaattttttttatttgtcctgttttaaaaattgagttcttggactagatgtaaagtagacaggagaaaatgataataaaaaatatatttatagcagaactctttcaagtttggtgacacctattttagcaataccagtacatgaagaaaaaatatagcttacatgctaactccccaaagtggaacatacgtatactttttctctattccatagatttgtatttgatcttccttctgcctcaacctaatttttgtgcagatgaagtttaacttactctattttgcatcaacattgaatccttcagtactatgttcagtctttcagtgtcttttttcgcttcgtaaattgaaatggtcatgatatattaagatttaaagaaatccaaaataagtatcttttgagatgcagagaaaaatacagcactttgaaattttcctaagttgtaaataaatcctcctttttgaaaattgttatgtcccgttcctttggcttaatgacttttaaattttcttatcctgctatatgtcttaaagttattttaaggtaattattttcattattttattttctcttccaggttaacagaaccttctggatatttaacagatggcccaattaactataaatataaaactaaatgtacttggctcattgaaggctagtaagtatacagtctgagtcaaattaatgtattttattcttaaatgataaaggtgatcatattaatgtcagagcattagagtataattactttatcatttagtttgtttattattagataatatttacaacttctagacatcacatttaatgtaaattacactacctcttcacttgtgacagtagtttaatttttatatatattttgtttttgagttatgttattgtggtattaaattgagtaggcatttttttggtttattttgaacatcttgttatgaaatttgaagacttagaaattataaaagtatttcttgctgagctatgctattcatataatttagcattttagttcaaagggtatttttaaaagaacattttgtagaagagagagttaattattcatttagaggtattttcagtaagtagggcttgaaacaatctatctatttaaatgtattgtgaatggagcataaaagaattgatatgaattatttttgaactgttttgtaatttctaaagagtatatttggaaaattttgtatttaaatttttctaacttaaaagctgttcattctctgctgtgcacctgtagttacattttgtttatttgttaacattatatcacattgagaattttgattaaaatttaaatagttttttagtgcctccaacttaagggttctgtaaaaataagaatagtggcttcttgagtgttgatttttaaaaatcaactttatttaagtaccatttgtatacaacaaaatgcacccatttttaagtgtacagttccataaggtttcagtgatgtatacagtctatgtaacctctgccttcaatcaagagaaagattttttttttttgagacagagcctcattctgttacccaggctggagtgcggtggtgcgatctcggctcactgcagcctctgcctcctgagttcaagcaattctcctgcctcagcctcctgagtagctgggactagaggtgcatgccgccatgcgcagctaatttttgtattttcagtagaaatgggttttaccatgttggccaggatggtcttgatctcctgacctcgtgatctgcctgctttggcctcccaaagtgccgggattacaggcgagagccactgcacctggctgaacattttttattgactacatttttagaaaacaatgatacatacatatgtcctgttaatagattttgaaagttacattttatttgtacaaattagatatgatggcttatcaatctttcaccctgataaggatttatagcaaaattatctataaacagatttctaataaaataccctatctaaagtttcttcactctgtgctttgtatattatataataaatattatgtatttattcactctgtgctttgtatattttaatttgaaaaatatttcatattcattttcagtccaaatgcagtgttaagattaagattcaatcattttgctacagaatgtagctgggatcatatgtatgtttatgatggagattcaatatatgcacctttaatagctgtacttaggtgagtaattatatttaatcagttgcagaaaagtgactgtgtaattgcttctttaaatatatattgatatgtactgcaaaataaatttagtaaagatattgatagttacatttcacagatgattataatactttgttatgtgctgtaactgtcaatttaggtaataattatgtaaatattgatataacataaataagtactatattggaaatatagatttctttctaaatattttttattctcattgtatttagtttattctttcaaagtgccttgaatatgttttcagaactatctggatatattagcgtgagttctagctgacaaataaatagacaagttttgttttttaatagttgtttttttattttagtgaaatggtaaaattttaaattctgcataaaagggttaagttatgctttgtgcaatgattaataaagatggagtttctaccaattgtcaaaatgtgagagttttatttgtttcaaaatattttattgttagtcgtaaggtagattattaattttaaaattatagcattgtatcaatttaaaaatcttttcttgtgtatgtttagattattataaaaagtttcgtgaataggagaaaatctattagacacagaaaaaattatgaacatgtatagattttatatataatttaacatgattgttgataagttactcattatattatttacttttgctatttatacaatatctgttatatgttctgtcattgctggaaatttaagtatggataaaagcttattggtcccttcaaaatattttctttccaatttttctttttattattcatgtggcaaatattctatttcattctattctaatacattttattttgttctattttatcaggaatgtgaattattattttggacaaaaatgtaacgacttgtatttccttaggagcttaggtacttattctatgatattgctattgcttacatttttgagtcatttgaacattagaaaaaggatagccataagcagcccttcatctaaggacaatagagagaaaatagagtggagccttgcaaataattaggttgtaagataatttattgtaacaattaaatttgatcctcagttcatacatttatttttagcaatttaaacatcactttgctatctttactctatttttatgataccgttgactgaccatcatttagatgtgtgcctgttcatttgtttatctagtaattctaattactttgtattaatactcatccattagcattcttaccaacattttcttgttattaaaggaagataattagcaggtgagatttagtatatggctgtgaagatggaattagtgatttctcattagcaagtgttcttgttagccctcctaagggaaatggaaaactcatgtttattgatattgaatatccacttgatgttaagcactaggctaggcagtttaaatgtcatctaatcctcacaaagatctcgttgggggagtactaagtactattatccccattttacagttgagaaaattgacattcagagaagttatttgcttctaatagatggtagagctaggattaggacttgaatctcaatctcctgatttaaaagcatatgctgtttgtacttcatcttgctaagaattcagaatctaatatgtttgaattacttcaattgtataaatatttattactcaacatttaattacagagactgtgtcacaggcttagagtacatagtaaggaagaaggcataggctatcgcagtggctttagacaccaactacctgcagttgggctagaacagatttcctaggttaagagcacagtcctctacaacaagggtctcctctccaccccagatccccgtaccagtccatggcctgttagcaacagggctacacagtaggaagtgagtggcgggcaagtgagcaaagcttcatctttatttacagctgctccccactgcttgcattactgcctgagctccaccttctgtcagatcagcagcggcattagattgtcataggagtacagaccctactgtgaactgtgcatgtgagggatctaggttgctcattccttatgaggttctaatgcctgatggtctgtcactgtctcccatcagccccagatgggaccatctagttgcaggaaatcaagttcagggcttccactgattctacattatggcgggttgtataattatttgattacatattacaatgtaataataatagaaataaagtgcataataaatgtaatatgcttgaatcatcccaaaatcatcctcccccggtctgtggaaattttgtcttccatgaaactggtctctggttccaaaaaggttggggattgctgctctataacactgctgtcatttcagacactagctgcaagcttggtgctccccacctactctgaccatctggctacatatttaggggttcctactctgtcctaaaagtttgataattcactagaattatcatagaactcaggaaagttctacacttatgactatagttttatcatgaaggatagaaatcagagccagccaaataaagggatgcatagagtgaggtctgggaggatcataaatgcaaagcttctgggtcctcagaatgtgttacccacccagcacatcaacatgtatcaccaacagggaagctcatctgagcttcaggtgtccagagttttattgaagtttcattatgtagccatgagtgattgaatcattggccatgaggctgaactcaaatctccagcccctcccatccccttctctctcgggaagttaggctaataccatatggccccaacattttaatcacatggttagtgtttctggagtggccatcccctattctgaattatatctttagcttaaattaattaggggcccaccatgagtcacctcattggcataaattttcagggctcaccatgaataggaagacactcccatcactcaggaaatttcaagaatttagaggttatgtcccaagaactggggacaaaagccagccaaattctttagtatgcagtagtcatgcattagtgggggtatgtaaacagatttttcacacagcctagttagtgttacaatcaggttatgaaggagttctatataatttcaaaataaataactaatccttcatgttgactttcatcgtgagtaaaagtatgaagtatgggggtcagataggacattctagagagagaaaagcatatatacaaaggtatagacacattaaagagcattatattttagggcaatagttgaaagttttgagtaacttgattgtaggaactgtgaaggatacgtaggagtcacattaccccaaaacagcaatcagtgacatttacttagtgctcattttgtgccaatgtacaggagttctttatatgcattagtttatttaatcctcaaaataacctttaggtaggtattaatattgtaattttacaaatgcagaattgagacacagagattttctgtgagtggcccgaaggttgcctagctggtaagtcagaatatgaatcaaggttatgtaattataggtcctaatcccttaatcactgtaatattgcttgcttgtacaccacactaaagaagttgggcttttattctgtaggcaagagtttttagaatgtggagaatgcattggaatggagaagtgttatttttttttttttttactgtgtgctggacaattgtgtgttggacgttgttgtttggaaaatcatatatagtaataatttgaggcctagaaagattatattcttgcagagactacctggggacactcgcaatccatattcaactcaatccaaactcagatactgaggtgattcatagctcagctgcagtgcagtcctttggagggcctaactttaggtagtttgctttcacttccaaccattggagtcccagttcaacgtgaaggccttgtgtttcactttttctttccttcattctgtaaaatccctgaaattaccaccgagttttttttagcccttcaaatcttacctccagccttgaaatcagcaaatgccaatagggtaaatgacctcaatgcctgggcaggccttcaagctgatttttttgtttttatataatttgtcattttactagatttcagttggtccgaatttcctggtgtattatacagtaagtggaaactctcttttatttattgtttttaaaatacttgtaaacaaaaaaccaaacagatctattcttttttgtttgtttgtttttttgagacggagtctcgctctgtcaccaggctggagtgcagtggtgtgatctcggctcactgcaacctccacctcccaggttcaagcgattctcctgcctcagcctcccgagtagctgagactacaggcatgcaccaccgtgcccacctgatttttttgtatttttagtagaaatggggtttcactgtgttggccaggatgttcctgatctcttgacctcgttatccgcctgcctccaccttccaaagtactgggattacaggcatgagccactgcgcctggcccagacctattctttttatctttttcagagagcgctcagagactagctgtatctattataaagacctatttttagtaatactcacctttatataattttattacaatgaacaatatgtatgtataacttaagactggtgtcatagggtttgtattgttttgagagtctcattttaaaatcatttgttgcttcacaaacataacctagtagatgtaataataattactaaagcgttaaatcaagagttgattactttttaacttgtttgcatttgagaatgtattttctaaatcaattatttgactataatatttcatttatgtgtcaaatatgatttgaatgggggaattcagttcttagtggtacctaaacataattttaactgtttaaaggaattgaccgtgtcgagttatataatttgtttgttagcagcttcttttctttcaccaattgcatgttttcatagatttagagaggttagaacatataactaaatgaagataggtaattttcctcatgaacaagtatccttaaaaagaagtacaagttaccagtttaaaactattttgtacatttatatctcccccaccccaagtttttgtttgtgtgcttatgggcttatgtgagcaatattctgtcttggaatagttatatattaatgcaatttgcatagatatgcaaaattagaaaaacattaaagtctatatagttttaaattttttgaagtaaatattttaaatcacctagataaatgtattggaaatgtacagctataactagaatgtaattgtaattgcttaactgatgtagagtgtcttccagcttcatcggatttttaaaccaatcagaatgagtaaaggtacagggttttattagagtagcaaggtgactttaagtgaagttttatacgaattaagtggaagactaccctgtagtattatgacaggatggatagcaggacaaaaaggagaaatgagacattgccttacaaatagtgataagaaaaaaaatggggtacagtggcatgagagtagattttagtgtattggcagcagtagtagaactaatttagtgagaaatggatagggacttcttttagatgtattctccttttagttgcccattctgacgtacaagcattactgatcctggtaagaatatttctgagtaaattttatgtgcttaacagtcttatgtatatctatacatacaatattcagttttgttctcttttagtggtttgatagtccctgaaataaggggcaatgaaactgtgcctgaagttgttactacatctggctatgcactgttacatttttttagtgatgctgcgtataatctaactggtttcaacattttctattcgtaagtattttttaaaaattccttcttttaatgattcttgtaatttaatgtaaaagaggttttttttgtttatttttattaatgtcttgtataccagaagcaggctaccgtgttaaatttcaaattagtaggcaggatcccttcttaagtgacataaaatcttaataatatgccacaaaacgtgatctaaacctataagtttggttgaaaattaattatgaaattgacaattgttttttggcaagtgattaagtaaacaagtactagtgtagctttactggtagcaacagatgtggtgagactgcagggagttgtgaactgcctttcagtgctctaaggtatatcacttgtaatttgaagaggattatgggagctaagtttttgtagtccctattgcagagactgtactgaaagctatgcatacattatgtcatttaattaccttcaattctgtcaagtgggtatatttcccattgacacatgaggaaattgtggcttaagagttaagtggctataccactatctcctctaaaataagaaaagtaatattcattgagaatctattatatgcctgatactttatatacatttttatatctagaagactgagggtgaagtaatgagagatgctttcacaggaatggctagagaggaagtctatatattatttttttcttttcttcagaatgtagaaattggtaaccagagaatttttcaccagaaatattataaatatccttgaatcagcaatttattatggaatttatttatcctacaacgtatccaagtatgtatgcaagggagaacaaatatatagtagaatataatcacatggtggctcacgcctgtaatcccagcactttgggaggccgaggcgggcagatcacgaggtcaggagatcaagaccatcttggctaacacggtgaaaccctgtctctactaaaaatacaaaaaaattagccaggcatggtggcgggcgcctgtagtcccagctactcgggaggctgaggcaggagaatggtgtgaacctgggaggcggagctttcagtgagccgagatcgcaccactgcattccagcctgggcgacagagcgagactgtgtctcaaaaaaaaaaaaaaaagagtcttaaagctaaatatgataaacataccttttcttcaataacagtgtatgggtgatagcatgctcttttatattatacaaccaagttatatcttgacttctcatatagttttgaattttcatgaatttaatttttttctgtaaaatatacaatcaaaacattgagtacttaagtctttacaaaacattttgcctggaaccgtacagatcctgcagatgttgagcatgtagtcgttagacatttggagtcttggtatcaaagtaaatctgttgaataaaataagaccaactgcaaataaatactaacaatttcataagagtaagagggtacagagtaaagaattaaaactacattgtgaaattctgttacatttataagcacataggacacagtataaaaattataaagtttatgatgtatcaaccaaaattctttttcaattaccttgaatctgaatatatatgaattatattttacagaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtaagcatgtgtggtgtgatggcttttgaaacattgattcatatatgtaatagattaatacaaattccacacgtttgtttcgttatagtttgcacacccaagccttatatatttacttttatttttagaatgttcagattaataatcaacttcttaataatttttttgtcacaaatagaattaattggcaaagattttgtctccatactactttgaagatcaaatgaagttatatatgaaactgaattgttaggtgtgtgataattatggtcttctgtaatttgttgttgaatctccccaaatttggtgacttcactgaatttaatgtggtgcattcaaatttgatttataagggtaatataaatagtatactacaaaaataaatgttcaaagggactgcagtatatgaaacttatttcttaggaaaggctgacatcttgtggctattttaaaaagaactagactatttttaaaagtattttagctgcctattgcagaagtcagatacctaggaaagaatttctaagtaatttttataaatatctatcatcaaagattaagtttagactacagtgaagaatgttggcttatttatctgtatataaaataataaatattgtcattatgaaattaagagatatgcttatacatatacctacccacctagagcttactttttgctagttacatttacctatgaagagcttcctttgtgccaacatattaatcctgttgaaatagggaaatttgactcaataattacataacctgaagtacttgattatgtattattataacacagtgtaataaatagtagcaatagttcccaagttaaaaaccaaagagaacatactcttcatgaagttgtattcattattcctgagatgaccttttcaaaaaagtgttgttgggtatgttgagtacttacttagaggaattattttaggctttgtgtaaattatgcctgtcttaagctcatgttagctcattaaaaaatattaggtatgtcaactgcacaaaagatctatgatttcttattaaatcgaatttggttaccaattgcaattatgtcagatgcaaatttctaaatgttttgtaattacagggacatgtattttaagtgactcttttaatcatttatgacttttcttccccccaaaagtgccttgagatgtaattttattttcatttctgtcgtgaaactaaaataactgtcttttctatagagacagtggtgtatccatattatatttgatttaaggcctgagaaatagaaatatagctcatatacacagtatttttcaaactggtcttcaattgctattagtctccacctcatttcagcagtcttaaaagcaaatgaggaatacatttgtataacattctctgtgaacaactctgccccttttctgttttttacttactttcattagtccttctttgaaatgctttattttgtgtaagtcttgtaatatagatctgattcaaagtattaagaatttttttctggcctttgttttttggccttttcatatcctattattctcatctgtaatgtcccaaatcataagaattcctgaatctaatatgtctataagcaaatggaaatgaggaagcaaatactgggtatgttcacttttaaagcaaagttatattatcagtagtctaagaactacttgtctgtgtgtgtgtatgtgtgtgtgtatgcatatatacacatatatttataactacatatatattttatatggagaatagtgtgaaagtgctttgtaaattataaaacgcagaaataagacaattttataccattttcttaataattaaggaaatgatttctgaattgatatgtttgaaggaggccttgtaaatgagataatatggtgttttcaagacaaattatgtgcagactggttactttgtgcctcaaactgatcctgattctgtatttaaggaagcatagctccaaagaaggtaggattgtgagcaaactcatttaggggaaaatgatgtttttatttcagatatatatagaatgggaaggaatcagtgaggtaagaagaggagatagatttgcttctaggacaaatggggaatgatcaaagaatgagagacatgtgaaaatgcggactgccgaggcaatctttatgaggttcaaaatctggtagttttatacaaggtgttatttggaactggattatttaggttagagtaacagattgttgttacctccattatattttatcctttgttgttgcttgactacttattctgtttggctgtatgcctaatgtatattttttaaaaatgagtgttaccctctagaaacttgggttttattaagataacacagaggaaaaacctagctttatattaagtcctttttttatttttatttttatttttttattatactttaagttctagggcacatgtgcacaacgtgcaggtttgttacatatgtatacatgtgccatgttggggtgctgcacccattaacacgtcacttacattaggtgtatctcctaattctatccctcccccctccccacaccccacaacaggccccagtgtgggatgttccccttcctgtgtccaagtgttctcattgttcaattcccacctataagtgagaacacgcggtgtttggtttttttgtccttgcgatagtttgctgagaatgatggtttccagcgtcatccatgtccctacaaaggacatgaactcatcattttttatggctgtatagtattccatggtgtatttgtgccacattttcttaatccagtctatcattgatggacatttgggttggttccaagtctttgctattgtgaatagtgccgcaataaacatatgtgtgcatgtgtctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacattctctccagcacctgttgtttcctgagtttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccctcacccactttttgatggggttgtttgattttttcctgtaaatttgttggagttctttgtagattctggatattagccctttgtcagatgagtagattgcaaaaattttctcccattctgtaggttgcgttttcactctgatggtagtttcttttgctgtgcagaagttctttagtttaattagatcccatttgccaattttggcttttgttgccattgcttttggtgttttagacatgaagtccttgcccatgcctatgtcctgaatggtattgcctaggttttcttctagggtttttatggttttcagtccaacatttaagtctttaatttatcttgaattattttttgtataagatgtaaggaagagatccagtttcagccttctacatatggctagccagttttcccagaaccatttattaaatagggaatcctttccccatttcttgtttttgtcaggtttgtcaaagatcaggtggttgtagatgtgtggtattatttctgagggctctgttctgttccattggtctatatctctgttttgataccagtaccatgctgttttggttactatagccttgtaatatagtttgaagtcgggtagcaaatggaaaacaaaaaaagcctgaggttgcaatcctagtctctgataaaacagactttaaaccaacaaacatcaaaagagataaagaaggccattacttaatggtaaagggatcaattgaacaagaagagctgactatcctaaatatatatgcacccaatacaggagcacccagattcataaagcaagtccttagaggcccacaaagagacttagactcccacacaataataatgggagactttaacaccccactgtcaatattagacagatcaatagacagaaggttaacagcgatatccaggaattgaactcagctctgcaccaagcggacctaatagacatctacagaactctccaccccaattcgacagaagatacattcttctcagcaccacattgcacttattccaaaattgaccacatagttggaagtaaagcactcctcagcaaatgtgaaagaacagaagttataacaagctgtctctcagaccacagtgcaatcaaactagaactcaggattaagaaactcactcaaaactgctcaactacatggaaactgaacaacttgctcctgaatgactactgggtacataacgaaatgaaggcagaaataaagatgttcttgaaaccaatgagaacaaagacacacaatctctgggacacattcaaagcattgtgtagagggaaatttatagcactaaatgcccacaacagaaagcaggaaagatctaaaattgacaccctaacatcacaattaaaagaactagagaagcaagagcaaaaacattcaaaagctagcagaagacaagaaataactaagatcagagcagaactgaaggagatagagacacaaaacccttcaaaaaatcaatgaatccaggagctggttttttgaaaagatcaacaaaattgatagaccattagcaagactaataaagaagaaaagagagaagaatcaaatagatgcaataaaaaatgataaaggggatatcaccacagatcccacagagatacaaacaaccatcagagaatactataaacacctctatgcaaatgaactagaaaatctagaagaaatggataatttctcgacacacacaccctcccaagactaaccaggaagaagttgaatctctgaatagaccaaaaacaggctctgaaattgaggcaataattaatagcttaccaagcaaaaaatgtccaggaccagacggattcacaggtgaattataccagaggtacaaggaggagctggtaccattccttctgaaactatttcaatcaatagaaaaagagggaatcctccctaactcattttatgaggccagcatcatcctgataccaaagcctggcagagacacaacaaaaaaagagaattttagaccaatatctctgatgaacatcaatgcaaaaatcctcaataaaatcctggcaaaccgaatccagcaacacatcaaaaagcttatccaccatgatcaagtgggcttcatccctgagatgcaaggctagttcaacatatgcaaatcaataagcgtaatccagcatataaacagaaccaaagacaaaaaccacatgattatctcaatagatgcagaaaaggcctttgacaaaattcaacagcccttcatgctaaaaactctcaataaattcggtattgatgggatgtatctcaaaatcataagaggtatttatgacaaacccacagccaatatcataccgaatgggcaaaaactggaagccttccctttgaaaacgggcacaagacagggatgccctctctcaccagtcctattcaacatagtgttggaagttctggccagggcaatcaggcaggagaaagaaatagaaggtattcaattaggaaaagaggaagtcaaattgtccctgtttgcagatgacatgattgtatatttagaaaaccccatcatctcagcccaaaatctccttaagctgataagcaacttcagcaaagtctcaggatacaaaatcatgtgcaaaaatcacaagcattcttatacaccaataacattcaaacagagagccaaatcatgagtgaactcccattcacaactgcttcaaagagaataaaatacctaggaatccaacttacaagggacgtgaaggacctcttcaaggaggactacaaaccactgctcaacgaaataaaagaggatacaaacaaatggaagaacattccatactcatggataggaggaatcaatattgtgaaaatggccatactgcccaaggtaatttatagatcagtgccatccccatgaagctaccaatgagtttcttcacagaattggaaaaaactactttaaagttcatatggaaccaaaaagagcctgcattgccaagtcaatcctaagccaaaagaacaaagctggaggcatcacgctccctgacttcaaagtatgttaagtcttgagttccttcctaacatttctcttttgcttaacctacctggtcttgtgtgtcatttttttttctttggtttttctttttcttggagataggatctcactctgtggctcaggctagagtgcagtggcatgatcgcagctctttgcagcgttgaccttccatgttgaaatgatcctcccaactcagcctccggagtagctggcaccacaggttgcacaccaccattcccagctaattaaattgttttttttttttagagatgagatctttctatgttgctcagactggtctcaaactcctgggctccagtgatcctcccaccttggcctttagagtagctgggactactcgagggcacacaagtttgttgtataatatttaattttgtcataaagtatagttgtcaaagataatgatatatacatattaaatatatgactaaaagtatagggacctgtgtagactcatctgcttctatgacagtaaaataaaaaaaatagacttcatagtttgaggttcacaggaaaattgagcagaaggtacagagaattcccatttacctcctgccccaatgcatacacagcttctctcattatcagtatctcccaccagagtgtatattcattacagttcatgagctcacactgacaaatcattatcaaccaaagtcatagtttacattagcattcactgtcagtgttggacattctgtgggtttggacaaatgtatcattacatgtatccaccattatagtatcaacagaatagtttttttaacctaaaaatcccctatgctctgcctattcattctttcctctccctacccctgccaaccactgatctttttactgtctccacaattttgccttttcccaaatatcatatggttgtaatcatacagtatgtagctttttatgattggcctttttgacttgacaagatatgtttaagtttcctccatgtctttttatggcttgatagctaattccttttcagcactgaataatattccattatatggatgtaccacagtttgtttatccattcacctactgaaggacatcttggttgcttctgtaaaatttgtttaaattttagtaagtcacctgagggaaaaaggcaactttgaaaagaactgatctcttaaaatggcttccaaacattgggatagaagagcaatttttataacacatgaaaagcaagatataagaaattgaattcatgttcatgtgtaaagaacacaatagaacagtaattttcaaagtactctgttttatataacttttaaaaaatctgaggaggctgaggcaggagaatcacttgaacccaggaggtggaggttgtgagccaagatcgcaccattgcactccagcctgggcaacaagaatgaaaatccatctcaaaaaaaaatctgaatgatgggaggtctttggttgaaagcaacagaaacaatctggcttacttgagcagaaaagtcagttattggaaagtatgcagagacagagactgctgtctcctagcattcattatagaattctcattgtaatagaattctcatttagctcagcacatggccttccatctacataccaaatttctcatgctgccttgcagctagtatggctatgttactgtattagtctgttttatgctgttgataaagacatacccaagactgggcaatttacaaaagaaagagatttaatggacttacaattccacatggctgggggggcctcacaatcatggcacaaggtggaaggcatgtctcacatggcagcagacaagataagagagcttgtacagggaagctccccctttttaaaaccatcagatcttgtgagtcttatttgctatcatgagaatagcaagggaaagacctgcccccatgattcagttacctcctactgggtcccgcccaaaacacatgggaattcaagatgagatttgggtggggacacagccaaaccatatcattctgccactggcccctcccaaatctcatgtcctcacatttcaaaaccaatgatgccttcccaacagtcccccgaagtcataactcatttcagcattaactctaaagtcctaagtctcatctgagacaaggcaagtcccttctgcctgtgagcctgtaaaatcaaaagcaagttagttacttcctagataacaatcagggtacagccattgggtaaatacagccattccaaatgggagaaattggcaaagcaaaggggccacaggcctcatgcaagtctgaaatccagcagtgcagtcaaaccttaaagctccaaaatgatctcctttgactccaggtctcacatccgggtcacgctgatgcaagaggtgggctcccatggtcttgggcagctctgctcctgtggctttgcagggtttagtcccacctcccacttgctttcaggggctggcattgagtgtctgtggcttttccaggcacatggtgcaagctgttggtggatctaccattactggggtcttgaggacagtggccctcttctcacagctccactaggtggtgccccagtagggactctgtgtgggggtccaaccctacgtttcccttctgcactgccctagcagaggttctccatgagggctctgcccctgcagcagacttctgcctgggcatccaggcattttcatacatcctccgaaatctaggtgaaggttcccaaacctcaatttttgacttgcatgtacctgaaggctcaacaccacatggaagctgccaaggcctggggcttccaccctctgaagcaacatccagaactgtaccttggccctttttagccatggctggagtggctggaatacagggtaccaagtccctaggctgtacagagcaggggggccctgggcctgagccatgaagtcatcttttcctcataggcctctgggcctgtgatgggaggcgatgctgtgaagaccactgacgtgccctggagacattttccccattgtcttggtgattaacattcagctcctcattacttatgcaaatttatgcagccagctttctccttataaaatgggattttcttttctatggcattgtcaggctgcacattttccaaacttttatgctgtgtgtcccttttaaaactgaatgcctttaacagaatccaagtcatatcttgaatgctttgctgcttagaaatttcttccaccagataccctaaatcatctttctcaagttcaaagctccacaaatctctagggcaggggcaaaatgccacgaatctctttgctaaaacaaaacaagagtcacctttgttccatttcccaacaagttcctcctcatctccatctgagaccacctcagcctggatttcattgtccatatgattatcagcatttttgtcaaagtcattcgacaagtctctagggagtccacactttcccacatttttctatcttcttctgagcctttcaaagcgtttcaacctctgcctgttacgcagttccaaagtcacttctacattttcgggtatcttttcagccgcgctccactctactggtaccaatttactgtattagtctgttttcacactgctgataaagacatacctgagaccaggcaatttacaaaacaaagagatttaatggacttacagttccacatggttgtggaggcctcacaatcatggtggaaggtggaaggcatgtctcacatggcggcagacaacagaagaaagattgtgcaggtaaactcccctttttacaaccatcagatcttgtgagacttacttgctatcacgagaagagcacaggaaagacctacccccatgtttcagttacctcctactgggtcccttccataacgtgggaattcaagatgagatttgggtgaggacacaaccaaaccatatcagttactaagtttagattggtaggatgtgagtagaaaatctgtatgcaaatattagatcattcagatattttcctatggctgataaatggcaacaactataataagtagcactggcccattcatctctagaatgttcattagagagaaataagcttttcccttcttttagcaacttattttgcttcactcaacctgttctctgaataatacaaaaggatattgagtagctcacaagagaaatgagaagactggataaactattgttggaaagaggccagatacaaataaaggctagcctacagcaaagatgaagccaatggaaagtttgagtaggatattcctgtcattgccacaggatcctgggttactaccactggcaccctttcagtaggtactgcatgctacaggaatggagagaaagaattgtaaattgcctttacatctttgcatcacttattaagactgagtcctgcttaatagtatctgcttggctaaacctaggtcttgtccataccgtggctgcctagagatatgaaatagggaatttaacttttctgttatatgtagtgaaagaggttctctttctggacaaaatccacacaataaaggattctcccaaacacaggaaaggggattcaaatgattgagattcccaaacaaataaaaaattcaaataatatatttttagctatagattgttaccataattaacaaggaatgggctaatttgttctctcatgtctactcagagaaactttgtaatgtggactagatgtaggggtagacaggttaagagacaaaccagcaagcttcagcatacaattttttcttaatgtattacaacagattttttttcctattctacagagaacagtgaaaaacaggtcaccatcatttatatgtaagagagttgcttaactgttatcaaattgttcctgttccttttctattccagaatgtcctgctcaatcctattgctcgattcttttaaatgtcttcaggacatttttatgtttttagtattcctttttaattcaattcagctacagttctcatataaggattgaagttggctgttttaaactcttaaattattgattgaaatacagtatctggaaatgtaaatcatgtaatttaatagttttgttgcgtagtgcctctgatctttatttaaagtcacactttattgtaacttactccagtttctcagatgctctttgtccttcactatctcaagacctttcttaattccaaagttcttcctagaaaacccttaccccattcatattctaagtccaggtcagatccccctgtaatatgctgtcataagaccctatcttttaaatttatatcatttatccctgtttataattatgtgcttgtatgattctttgattatctttcccagtggaatataaactccaagaagttaagaatgattatgttttgatcatctttgggtttccagaacctaatatagtgcatggcatgtactagccacttgcatttgttgttgttattgaatgaatgaattagaaatgtattagtttactagtatagtgatatgtagacattcaactagagatgttttataaggttattactctaataaactatgttatttacttcctgtataattacttctgaacattgagataagcaattgaatttgaacattttttaaaatgttattttatcaagcattggttcttggaatcttggtcttattttgtttcaatcctttggttttagattttaacatttgccattgggtggcagtattgactaccagaaaactcacttaaactctggcattcaagttgtagaaacttggtagttttgtttgacttagaaaaatgtaaaaactttcaactcaaactcatgaatattttatctgaagtattttatctgggttagtcatataacatataaggacatatttagttattttaggatagtatacacatgagattataggttgccttgtagaaattcataaagtagcttacattttcctttagaaatataataataatgaacacggtcaatctatttcttctcttttaactttgaggagggagaagtgacaggtaatgcgtttaattccgttaaattcttcccacttagcaaaaacagcagatctgacttttttgtgagagctaataaaattaaatttttactcttaacctactaagaaagttgactgtttgaaaataaaagcagcattaaaatgtatatatgacagccctttttcatgaattcatttatttatctttttcatttattaatgtaacagtttctttttttgagcttctattaagtgctagagactgctctaggtccttgggatacatcatggaacaaagaagacaaagatccttgtggaacttacattcaagctaggagagacagaccctaaataataaatatacattatatagtatgttagaaggtgataagtacaatggaaaattaaagtagaacagagaaagaggaatagaaagatctgggggttacatttaaaatatgatgatatgcttaggttttatggagaagttgacatgtgagaaaagactttaagcaagcaagagagttcaaccatatagatatctaggggaagaacattctaggcagagacctgtcagttcaaagaccctaaggcaagagcaagccaggtgtacataaggaccagtaaaaaggccattgtggctggaattgaattactgatggggagattagtcagatatgaacttagaagttacacaacaagggagatggttggggatgtggaattaaggggttgctggaggggatggagattcctgaaggatggagctatatcagctaaatattcttagctttgtagaccatagtgaggattttgactcttaccctaagtgaaatgagggagccattgaaggattttgagcagaagattagtattatgtggcttagttttataaagctcctattggtttccacctgagaatagactgtagtagcagtataccagttcagaggctactgctataatctaggtgagagatgatgatgatggtagcttggacaggttggtagctatggaggtggtgacaatggcttgaatactgaatgtgattttaatgcaggattaataggatttgctgatggtctagatgtggggggtgagggaaagaagagtcaaagatgactaaggtttttggtttgagcaaatggaaagacagagttgtcatcaactaatatgaggaagattttaggaagaatatttggttatggtatgccaagttagagatatctttgagatattcaaaaggagatagtgaggaggcagttggatatatgggtctggaaattgatggagagagatctgtactgtagatataaatttggaggtgttcgcttaaatattaaattggaaaccattgatgaaattggatgagattaccaggaaagttagcatagagagagagaatcgaaccaaagactgaactgtgggtcccaacaaaattcagagtatcctgtgctaggcatataaattcctttcttagataagcttgccttatgttgaactatttataaccacttattttgttgcctctgactttataagattttgttgcctctgactgcataggacaatgtaaaatgaacaaatcctgctctcaatatagctaattctacgtttgtcattttcagctgatcagaaccaaggtcttaaatctttcttgggattttttttttttatagtgtgtattgccctgtccatactcttaacatggtttatcaattttcttcaaagcataatatcttagctcaggctgctataacaaaataccacagattaggtcgcttaaacaataggcatttattcctcacagttctggagaccagaagtccaataccagggtgctatcatggtgagggccaccttcctggccctctcactctgccacataaagaacgaacaagatgactgcctttttgttctatccttatatgacagagagaaggagaggaggagagagcgagagcaagagagagccagagagagagagagggagagagaacgcacgtgagagtgcgaacttgtgagagctggagagagtgagcaagctctctggtctctccttgtaaggcactgatctcaccatgaggaccctaccctgataaccttatctaaatctaattacctgtccagagccccacctactaatactatcacgttgggagttagggtttcaacatataaattttgaagggacacaggcattcagtcaataatatgagaattttttttgtttcttttttttttttttttgagacagagtctttcactgccgcctgggctggagtgcagtgggctatcttggctcactgcaacctccgcctcccagtttcaagtgattctcctgcctcagcctcccaagtagctggattacaggtgcccaccaccacgcccagctaagtttttgtatttttttttttgagacggagtctcatgctgtcgcccaggctggagtgcagtggcgcgatctcggctcactgcaagttccgcctcctgggtttacgctattctcctgcctcagcctccggagtagctgggactgcaggcgcctgccaccatgcccgtctaattttttgtattttttagtagagacggggtttcatggggtctcaccgtgttagccaggatggtctcgacctcctgacctcgtgatccgccttcctcagcctcccaaagtgctgggattacaggcgtgagccactgtgcccggccaattttttgtatttttactagagacggggtttcactacgttggccaggctggtctcaaaactcctgacctcgtggtctgcccgccttagccgcccaaaatgctgggattacagacgtgagccaccgtgcctgggccatgaaaattcttagcatgaatatttcttaatgttatttcaatttatggaggaactattctctattcacaattaaagttatcttgggaaagtcaattaactatctggttataaatttcattatttatacaaagagattatttgcccttgtctgagtcttgggatgataacttgatcaaagtgaattgaaatagtgtcttgctgtttatgcttgactggctgataatacagtagcagtttcctttttagtaagtagacattttgtaatagtttgatttagtaaaatcttctgtttgcaatgaggttcagtacattttattaataaaaaaattgaatttgtgattaatatttatatattaggcaactatttacatattctgtgagcattatacatgcaccagtctaataaaatgggcagtttaacttttgtacctagaagaaattttgacatacatgctttcattattttataatttattattttagatgtttttgaaatatgattttgacagttacgattattcaaaaatctggtctttaaaatttttgaagttagtcttttctaagcatacatattttgataataccaggagttttcaaaatgtgtggtgcaagggttatataaggagatgggttggggtaggatggaagataagtgactcttccttttctgcctcaaccatagtgtcatcactttgcaatattttacatattgagattccttgtaaaactttgttttaagccttctgcagcccaaaaagagtaaattggaaaccattgatctttaaacaagagggcaatttgtttccatgccacaatagcatcattgaccgaaactgtaagagccaagtattcttggaacagatctagtataatgattaccactcacacaattcattgtcttataaaattaacagattgtcagaatagttgtggatatttaaaatagacaaaagttaatacctggcctttggagattgattttatgggtctagaacatgtgtagaatactttggatactgtaacaaaatcaaatttttaaaatggtgttagaagagagaacacttgcattgaaatcttgttttgacttttattggagaacttcagattcagtacatactaaatcataagactatatctggaatgattacaacaagctacatttacccctcttgctctaaaaatctttattcccaccatatcttccacttcttattaacaatccagtttcttctgggaaattgccttttgctaacgtagcatagtcttgctgggatgaaaaaatccaggtacctgtctattctaagcttgatttttctccttgaaaaactctctgaatttctacatattttttcaatacagtcccattttcccttaagctagccaaattaatttctgtgactcacatgtaagaaaacaaactgaagtaccaccttagagatactgttagggtgtgttttttttttctggttattagacttctttaaaatacccaaaattatatcagcaacctgcatttgatagaattcagagttagcaatatttatttaatgtgttcagttgaaaactgcaaaaagaaaataaatatagttggctctttaaacatgtaccacttcaacattaaaatgaatgcttttttcgtagtagtatagatgaaatataaattaagggtatgagccaaaattacatcaaaaagtctaaaatcctggagtaagattattttttgcttactttcccttttacttattttttattgatacataatatttacatatttatggggtatatgtgagtatttgttatccgcatagaatgtgtaatgatgaagtcagggtatttggggtattcttcactttgagtatttatcatttctgtgttgggagcatttcaagtgctcttttctaactacttagaaatatacaatatgttgttgccaactatagttaccctacactgccattgaatattataatttgtatcttctaactatatgtttgtatccattagccaatgtctgtcctcccccactacccacaccctgtccagcctctggtatccatcattctattctatacctccatgagatcaactcttttaactcccacgtgtgagtgagaacttaggatatttgtctttttgtggctagcttatttcatttaacataatgacctccagttccatccatgttgctacaaatgacatgatttcattcttttttttttttttgtggctgactagcgttccattatgtatatacactatattttcattatccttttgtctgttgagggacacttaggttgattccgtatctttgctactgtaaatagtgctgcagtaaatatgcaggtgcaggtatctctctgttacagtgattttgtctcctttggataaatacccagtagtgggattactggatcatatgatagttctattttaagttttttgaggagtttccatactgtttaccatagtggctgtactaatttacatccctaccaacactgtattaagagttcccttttctgtgtatccttgccagcatctgttatttttagtctttttaataataaccattttaactaagatgatatctcattgtggtttttgattggcaaattccctggtgattggtgatgttaaactatttttcatgtacctgttggccatttgtaagtcttcttttgagaaatgacttcatgatctttgctcacttttaaataggattatttgtttactgttcagttgtttgagttccttgtatatcctggattttaggtccctgtcagtaacatagttttcaaatattttctcccatcctgcaggttgtcttttcactttgtggattgtttcctttgctgtgcagaagctttttagttgaatatagtctcatttgtctatttttatttttgttgcctgtgcttttgaggtcttagccaaaaaatctttgcctaggtcaatgtctcaaagcattttgcctatgttttcttctagtagtttgatagttttgggtcttagggtttaagtctttaatccattttgagtttatttttgtatatggtgagagataaggggtgtagtttcattcttccacatgtgaatatccagtattcccagcacaatttattgaagagactgtgctttctccaatgtatgttcttggtgtctttgaaatcagtgagtataaatatgtaggtttattctttcactattatgtttcattgatctatatgtctggttttgtaccagtaccatgctgttttggttactatagccttgtaatatattttgaagtccagtggtgtgataccttcagccttattctttttgcttaggatttctttggctattggcctcttttttggttccatatgaattttagaattgttttttctaattttgtgaaaaatgactatggtagtttgcattgactctgtagattgctttgggtagtatggtcattttaacaatattaattctcccaatccatgtacatgggatgtctttccatttgtttgtgtcctcttcaatttctttcttctgtgttttgtagttttcctatagagattgtccacatgcttggttaaatatatttctaggtattttattttttttgtagctattgtattgccttcttgatttctgtctcagctagttcattatttgtgtatagaaatgctgcagatttttgtatattggttttgtaacctgcaactttactgaattcatttattacatttaagagttttttggtggaggctataggttttctagatataagattatatcatcagcaaagagtggcaatttgacttcctctttccagtttggatgcattttctttctttctcttgcctaatttctctggctaggacttgaagtagtatattgattaggtggtgaaagtggacatctttgtcttcctccagttcttagagaaaaagcttttggtttttctccatttggtattgaagtggcatcatttggggaaatagccaaggtttgttgtctcgcactaaggaaatcgaagacgtggacacacaatgagtgggtttaagagcagaaagtttaataggcaaagtaaagaagagaaaagctcccctgtgcagagagagtggtgttctgaatggatctccctctttgaggccagatgcgttttttttttttttttttttctttctaagaatctgactctgtcgcccaggctggaatgcagtgatgcgatcttggctcactgcaacatcctcctcccaggttcaagtgattctcctgtctcagcctcctgagtagctgggactacaggtgtgcgccaccacacccaggtaatttttgtatttttagtagagatgaggtttcgccatgtttcacctcctgacctcaggtgatccacctgccttgggctcccaaagtgctgggattagaggtgtcagccactgtgcctggctgtggttggttttatagaggggcttttggaggcggtgtctgatttacatagggcccagaggatttgttggaccaggtgtaccatttgcatagtgcactaagaggctggccatcccaccctaatcttttattacgcagatggggtcttttcctggccagtgtagacgcctgcacacatggcaacaaaagggaagggaaaatctccatgttgaatatacctggcttccaggtatcccttttctgttggcacagcttccagcattccagcttgcttatctatgcttgcagcttgatttttcaggctgctttttgttagaaaagaaatgattttggggctgtttttttttaaaaggaaattccactgagaactcttttacccttactaactgcctgaataatttctttttaactcctgtaacagtatgatattaactgtgggtttgtcgtatatgtccttttttatatcttggtatgttcctttcatgcttagtttgttgagagtttttatcgtgaagggatgttgaactttatcaaatgctttttctgcatctcttgagatgataatatggtttttgttcttcatgttgctgatatgatagatcacatttattgatttgcatatattgagccatccttgcatccctgggataaatctcacttgatcatggtttattatttttttaatatgctgctggatttggtattttttgagtatctttgcatctgtattcatcagggatgttggcctgtagttttcctttttttgttactttaatatttgggtttggtgttaggttaatcctggccttgtaaaatgaattagggacaattgtctccttttcctttttttttttttttttggactagcttgaggagaattggcattaattcttctttgaaagtttggtggactttggccgtgaagccgtcctgtcctggactttcctttgttgggagactttttattactactttgatcttttcagtttttaatggtctgtttaggttgtctaaatattttttcttgattcaatcttagtaggatgtatgtgtctaggaatttgtggattttctctatgttttccagtttgttagtgtatagttatttataataatctttgataatcttttgtatttctgtggtatcagttgtaacgtgtccttttacatttctgattttgttgatttgggttttctaatttttttttgttgttgttgcttaatctagcaagtggtttattggtagaccacatcttttcatgttgatcctttgtattttttttttccacctctatttcatttagttctgcttttatctttattatttatcttcttctagtaattttgagtttggtttattcttacttttctaattctttgaggtgcatcattagttcattttaaacctttctgcttttttgacgtgggtacttattgctgtaaacttccttcttagcattgcttttgctgtatccaatagcttttagtatgttatgttttgattttcatttgtttcaaaaagtttttttattttctctttaatttattctttaatcctttgatcatttaggaacatgtttttaaatttgcatgtatttgtacagtttccaaagttcctcttttcattgatttctagttttatttcattgtggtttcacaaggcatgattttgatttttaaattttttttgaagtttttttattattatactttaagttctaggacacatgtgtacaacttgcaggtttgttatatatgtatacatgtgccatgttggtgtgctgcacccattaactcatcatttacattaggtatatctcctaatgctatccctccctgctccccccaccccacgacaggccttggtgtgatgtttcccttcctgtgtccaagtgttctcattgttcaattcccacctatgagtgagaacacgcagtgtttggttttctgtccttgcgatagtttgctgagaatgatggtttccagcttcatccatgtccctacaaaggacatgaactcatcattttttattgctgcatagtatgctatggtgtatatgtgccacattttcttaatccagtctatcattgatggacatttgggttggtcccaagtctttgctattgtgaatagtgccgcaataaacatacgtgtgcatgtgtctttatagcagcatgatttataatcctttaggtatatacccagtaatggaatggctgggtcaaatggtatttctagttctagatccttgagggatcgccacactgtcttccacaatggttgaactagtttacagtcccaccaacagtgtaaaagcattcctatttctccacattctctccagcacctgttgtttcctgactttttaatgatcgccattctaactggtgtgagatggtatctcattgtggttttgatttgcatttctctgatggccagtgatgatgagcattttttcatgtgtctgttgactgcctaaatgtcttcttttgagaagtgtctgttcatatccttcgcccactttttgatggggttgtttttttcttgtaaatttgttggagttctttgtagattctggatattagccctttgccagatgagtacattgcaaaaactttctcccattctgtaggttgcctgttcactttgatggtagtttcttttgctgtgcagaagctgtttagttagatcccatttgtcaattttggcttttgttgccattgcttttggtgttttagacatgaagtccttgcccatgcctgtgtcctgaatggtattgcctaggttttcttctagggtttttatagttttaggtccaacatttaagtctttaattcatcttgaattaatttttgtataaggtgtaaggaagggatccagtttcagccttctacatatggctagccagttttcccagaaccatttattaaatagggaatcctttccccattaattgtttttgtcaggtttgtcaaagatcagatggctgtagatgtgtgatattatttctgagggctctgctctgttccattgatctatatctctgttttggtacctgtaccatgctgttttggttactgtagccttgtagtatagttggaagtcaggtagcatgatgcctccagctttgttcttttggcttaggattgtcttggcaatgtgggctcttttttggttccatatgaactttaaagtagtttttttccaattctgtgaagaaagtcattggtagcttgatggggatggcattgaatctataaattacctttggcagtatggccattttcacgatgttgattctccctgtccacgagcatggaatgttcttccatttgtttgtgtcctcttttatttcattgagcagtggtttgtagttctccttgaagaggtccttcacatcccttgtaagttggattcctaggtattttattccctttgaagcagttgtgaatgggagttcactcatgatttggctctgtgtttgtctattattggtgtataagaatgcttgtgatttttgcacatgattttgtatcctgagactttgctgaagttgcttatcagcttaaggagattttgggctgagatgatggggttttctaaatatacaatcatgtcatctgcaaacagggacaatttgacttcctcttttcctaattgaataccctctatttctttctcctgcctgattgccctggccagaacttccaacactatgttgaataagagtggtgagagagggcatccctgtcttgtgcccgttttcaaagggaatgcttccagtttttgcccattcaatatcatattggctgtgggtttgtcataaatacttcttattattttgagatacatcccatcaataccgaatttattgagattttttttagcatgaagggctgttgaattttgtcaaaggccttttctgcatctattgagataatcatgtggtttttgtctttggttctgtttatatgctggattacgcttattgatttgcatatgttgaactagccttgcatctcagggatgaagcccacttgatcatggtggataagctttttgatgtgttgctggattcggtttgccaggattttattgaggatttttgcattgatattcatcagagatattggtctaaaattctctttttttgttgtgtctctgccaggctttggtatcaggatgatgctggcctcataaaatgagttagggaggattccctctttttctattggttggaatagtttcagaaggaatggtaccagctcctccttatacctctggtagaattcggctgtgaatgtgtctggtcctggacattttttggttggtaagctattaattattgcctcaatttcagagcctggtctattcagggattcaacttcttcctggtttagtcttgggagggtgtatgtgtccaggaatttatccatttcttctagattttctagtttatttgcgtagagatgtttatagtattttctgatggtagtttgtatttctttgggatcggtggtgatatcccctttatcattttttattgcatctatttgattcttctctcttttcttcttcattagacttgctagcggtctatcaattttgttgattttttcaaaaatccagctcctgctcctggattcattgatttttttgaagggttttttgtgtctctatctccttcagttctgctctgatcttagttatttcttgtcttctgctagcttttgaatgtgtttgctcttgcttctctagttcttttaattgtgatgttagggtgtcaattttagatcttttctgctttctgttgtgggcatttagtgctataaatttccctctacacaatgctttgaatgtgtcccagagattgtgtgtctttgttctcattggtttcaagaacatctttatttctgccttcatttcgttatgtacccagtagtcattcaggagcaagttgttcagtttccatgtagttgagcagttttgagtgagtttcctaatcctgagttctagtttgattgcactgtggtctgagagacagcttgttataacttctgttctttcacatttgctgaggagtgctttacttccaactatgtggtcaattttggaataagtgcgatgtggtgctgagaagaatgtatcttctgtcgaattggggtggagagttctgtagatgtctattaggtccgcttggtgcagagctgagttcaattcctggatatcgttgttaaccttctgtctcattgatctgtctaatattgacagtggggtgttaaagtctcccattattattgtgtgggagtctaagtctctttgtaagtctctaaggacatgctttatgaatctgggtgttcctgtattgggtgcatataaatttaggatagttagctcttcttgttgaattgatccctttaccattatgtaatggtaaaggataccattcttcgaagaagaaaggtagcttctttgtctcttttgatctttgttggtttaaagtctgttttatcagagaaaaagaattgcaacccctgcccttttttgttttccttgagttttcttttgtgtcctaacatatagtctatcctggagaacattttatgtgctgatgagaagatgtgtattttgtagctgttgattgaaatgttctgtaaatgtctgctaggtccatttggtctaatgtgcagtttaaatccaatgtttctttttctgtctggatgatctgtctaatgctgagagtagggtgttgaagtccccaactgttattttattggatcaaataacactggtgccaagaaacggtgccagggagcccaagacaggcactcttagactgccactgtcacccctacggcccaaagattggcccagggccaatttctccctttaaatgtattaatttcttcctttaaatgtaataatgtttgctttatatgtctaggtgctccagtgatggctacatatttgtttagaattgttatatccttttgctgaattgatccctctatcattataaaatgaccttctttgtctctctttattgtttttgacttaacatctgttttatctaattagagttactcttgctcttttctagtttctgttttaatggattttttttctatccctttattttcagcctctatatgtctttacaggtggtatgagtttcctgcagttggatcatgtttttctttttttttctttttaaaaaatccattcagtcagtctgtgttttttaagtggaaggtttaatttgtttacaatcaaggtttctattgatatatggggacttaattatacttaatttttttgtgtataaaatgagaaggttgtcttaataataacaaagttactattatgaagcatttattatagtattaaatattaagcattttacttagaatctcattttatatttagaaaaatcttatattctaggtggaagctccacaattaaactgaagcttagagaaattaggtaagtttgcccaaggtttcacagctagtaagtaggaaagctagatttgactgcatagctcatgctgttactcctttacagcttaaggtgcttttcattcatccatccattgattgattgattccataagtgtatactgaggctaatcattagtaattgttggctatgttaagtacttttcattgtattttattatgatgggaagtcactgaaggattattagtaggggaatgataggagtagaattatgtttttaatcattctggttgcattctggatagttgaatgttataggaaagggataagtatggaaataagaagaccaggttttagactattgcagtagtccagttgagagtgggtggtggcttggactgaaatggtagttgtagagacagggatcagtggttggggtatcgtggggtgctagaatttaaaaattcttataattagtaagatacagaccagacaccaatcaaaatggatggtggccattggactagagtaagatcttgatgtgccgtgttgtgccaggcattacccctctagttatctattgtagggaggtttgaattatctcaagtgaggagtcaggggaacagggacagcaagactgataacgtgcgatgctgaggtacatctacttaccaacagtcattgaaacttttatactttaacatgtggaaagactgtaatccctgcatacctaattaatattcagtttgtttgtgggttggttgtatggggtgctggagaaagaggcaacttaagaatggcaccaaagtttttgccctgagcaactggatgaatggaagtgccgtttactcagctggcaaacactgctgaaggaattggtttgggaggaaacgatcaaggttttagttttatacatgtgaagtttgagatgaccctctatagatatccaagtggaaatgtaaagtagtagtttgaattcatgagagattgtggggctggacatatacatttgggatatatcagagcacaattctactctgtatgattatgtagtagctttttcccttaaaaaatctctcagcagcccgacactaatgcttaaagttacagtgttagaaattcatttatactctttggttttttaaaactgtgcataacctgcggagaagattctttttgaaattgcactataaggtgaatttgtttattacaccctttaaaaaacagctgagatatactaccttgagaaattgtcatactgattgagaaaagtaatgcagagagagttatggggatatattgcatgagatactaaagtatgaagtggtagaataatttttatggatatatttttataaaaaaggagtcttgcacatatagtatgttcttattcataagtgggggctaaaaaagttgatgtcatggaggtagagtagaatgatggttaccagaggctgggaaaggtttcggggagagagggatgacgagaggttggataatgtatacaaaaatatagtcagacagaggtaatatgttctagtacaataacatagtagggtgactatagttaataatttattatatatttcatagctagaatatttggaatgtttacaacacaaatgtgttcgaggcaacagatatcctaattaccttgttttggtcattacacattgtatacatgtatcaaaatattacatgtagaccataaatgtgtataattgttcagtatcagaaaaaaaattttaaaaagtggactcttgcttagatgtccttaagtgtagatattagtattagctgtttaatgggtggggaagtctttttgtcgttgtttgtgttttaaattaatattcagttaattagtatacattttaagtcattttggttatagaatacagaaagcttcaaattaagacatctaatttttttcttaaatctttgaattatatttataaatcttgtcattctatttataaatggattaatttagagtaaaataaagacaacatatagattgggctacagacctataacatcctggaactgcattccctgcattcttgcctccttgcctgttcctctatcttcagatccgggactgcagcatcttgctttgatagtcacattgcttccttctgcagtcaaatctccctctcttataaggacacctgtaattatatttagagccaatttagataattcacgataatctctcccaaatttcaaaatccttaatttaatacatctgtaaagttccttttgccatataaggtaaaatccaaagcttctggtggttaagacctggatacctttgagggctattattcagtccactggaaacttgttctgcagtattttgctttaatgcagatttgataaatatattggtgatttaaaaatgtacccaattttcaagatttttttcatgccagtgttctctatcaaactcttttccaagtaatacccacatattacttggctgctttcaactctgtgcctttgggtggtggcctgtttttaatgttttatttagaaataattttaaagttttagaaaagttatacaagaataagaatagtacaaagactatctgaatgtccgtttcccagattcacctattaacattttactctattttctttggtataactgacttacatgttaaaataaatctatatttccttttatgaaaatagatacaacatttataccaatagatgcattatatataatttctatatgatttcatgtcttttcagttaaattagaggttggcaaacttttctgtaaaaggccaggtagtaaatactttttctttgcaagttacatggctctgttgcaaccactcagctctgctaaagcagccatagacaatacttaactgaatgaacatggctgtgttttaataaaactattaaatgatttctaagttactgtaattaaattaaaaaagaggttcctttaatatctctgattactaaggaatagttcacagtcttttctcactcagaaataatagttttctatagctgatttaaaatattatcattatcaaagagataatctgagatacttcctagtttgtacctgaaaaatacagagccatacaatgtaagcattgaaaaaaatcttgaagatgaatcaattaatacctgggtgagtgaacacatgaagacatgaaaactgtatgggtcaatatttcttaaatcagactctgcttgggagttttaaaattttgttattaaatgacaatctaaaactttttgatataagcaaattgaagattaactgcctgatctcataattgagtaatgccactgtattgtaatgccagcagttgtgttgacaatttaaagttgggattaagtagtatccctttaattactgtaggctaaaaacaatacaactaaagtgtactaatacttttgtgacaagtgaagggtaaatgattatatgccatagtatatgaatttaaaagatttgtaaaaagtaggttgaagaaaaatggtgggagaattatgttgtcaaaataatgtaggtgtgctaaaattatgtaaaaaaggcattatgagaattaatatcatttttaacttgggacccattattttaaacaaaacaatattatcatattcagtaaatattagttttataaatttacttatatataatttataaatgtatgtttgttttatgcttataaaagaaatttaaacataggagtttatgtctagtatttgagaattttttagtttcattaaaattaaaatactttgtgagccctaaagtttgatgaaaatatattccctttaggagaattccttctattatgtttgagaaacactgatggggaaaccaagacttatgagtaacatcatgaatatggaaaggaaaaggctgtgttttcaactttatagtatttgaaattattctgcactaatttaataatttttattttatgatgcataatttttttttctttttgaggactccactgaagcaaactttggttgtccttaataatgctaaaaaaaatgtaatcttttttatgtttgtttaatagttaataatttttaaactttaatttttaaatgcttttacttccactattttaaaaaaataaatatttattataacccttggtggtagattattatatccatttgtgtagatggaggcttgatgatgaaagaggtaaacatacttccctgacagaactgatatttgagtacattgttttctattttaatactcttgtagcatactaaaataaatctgacattttatattatttaaataattctttaaaattgtgaaatttatttgaacatccaagtccgattgtgagtatatgacttttttcgcctctaagcattacattttctgtgagtattattcttgtaagttatatttcagataatttatgtatatatttgttaatatgataaacattgaattcttaaattctcttaatccatatgttgtatttctataatctgagggctttgtttaatctagtgtgttgtttcattttttttttaataggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaagtaagtatttattttcagattcttgctgttttttaagctggatttttatccaaaatgtcttttttttttaattgttgtccgagagtaaaagtggttatttttgtggtagtgtctatttgctagtgagactgatttgtgaatacatgaactcagtatgtccatagctgtcattgcacatagaagtatgcttcatgtagaaatgttattacttctctagagtacttttaataaattctgagtaagaaaatattaacttcaaatacaggcaggccttgcctataatggataaaatgaatcaaatgaatcatgccacctttttttttaatgaagtataatctcatatataaaaatcctctcaatttgttctgtaaattttagtgtacctgaactttactttgtatgtgctttacaaactttcattgggagaacagttctagtattatgagagagatgattgatttactgttggctcaatagagattgttctctgcatgattggataaggggaatcatatggatggcagctttatctgatttctttttcagctaatgattgtattttatgaactgtttagtaacaatacaaaaggaaatagggagaatcatttgatttttaatgttgcttccaggggtagtgttcatattatgtaataactggtacagcttgggcatcaaacaatcagaacttgccctggacagtatggcataatggtgtatacacaatagaattgccagatttagcagataaatatacaggatacccagttaaacttgaatttcagataaaaaacaagtacatttttagtataagaaggcccttttgctgtatatatatatattttttacaaattttgcatgggtcattctttaacaaaaaattgtttgttgtttatctgaattcaaatttaactgggtatcttgtattttatctgccaaccctaaccactgaatatattaaccctcataattaggaagatttcagaaattctgtaagaggagattgctttaaaactatgattgaatgcgactgaaattaaattagaaaatcgaataaattctggagagaaggagggagttttatgtaagtatttaagtggcaaattagaattttttaacatgaagaataaaatacagaaggaagaattgaaagagagttggtgggattaaaatgaattgttaagataaaaacctggagaaataatgatatttaaatgtgaaaattaaaaggaaattaactatgtttaaagaaaatgagaagtctatgaaagtagagtcgaactttgaattaaattgtgatatttccaaagtcgagtttgtaagacaaagagcaacattgtcaacaaggaagtttgtaaattttaagttcatgttctttgcaagatgagtagcatatcaaaaattaaatgatgaatattatttgctattcttttaaatttgcatattttccattggaaccagataaactatttaagccaacttttttttgtctgaaatctgagtattttggttacagtgtttatataaacaaatgagggattagagtagaataattgtgttgctgttttcacaggttagagaatacttttcatcattctgaatgtagttcaattgtaggtaaggataacagctttcagaagtgataggataagtcataacttgatttaatcatcttctatagtggaatttaattggggtggaaatgttacattttaagacaaattattcactaaatataaaagctctgtgttagtgtctattaaattagaaagacttttacagaatatatatacattaacattaatgaaaattaacatgtattcatgaggatagcaaacttttgaaaacactacgtgcttgtttcttgggatatatcattggatataacaaatgcccgtgtctttgtaaagttagggaggaaaggctggcaatgacaaaaaaaaaaacactattaccaaagtaaattatagacatgaacatatatacatatagagacagatgggatggatggatggatagatatagatagatagtaggagtaggtaaatcaggagtgccaaagaagagggagttgcaattataaatgtaatagttaaggtaggcttcataacaaaggtgagaactgagcaaaaacttgaaggagatcagaggattgcagttatttgtaggcgcagaaaagagccagatcaaagacttaagataggaactccttgaggtgtttgaggagcaacaaccaggcccatgcaatttgcatggaatatatgagagggatacattaaattagagtgataacagaggagagagacagatcatgtaggatgttgtagatcttttgggagtcatgggagggttttgagcatgtgttgatccatattttaaaagtgttaccatggcggtttattgatgatatactggggattaggaggaagattagaaacgggatttgagttaagatgaaattatcaagggaatgcattctagatagagaaaaggaccgggaactgagcctgaggcaccatatcactaagaggttgtggggaacaggggaagccatcaaaggagactgaaaaagaatgactggtgagataggaaaacctggagtacagtatcttcaaaggcaagaaaaggcattatgtgaggattaaggagtaattaataatgtcaaatgctgacgattatccaggtcaaggaaaatgaagactgaaaactggtcatggatttagcatgaggaaattgaccataacaaaagcagttttagtggaggggaggggttaaaagcgtgtctagagttagtttaagagagaatggaaagtggggtggggatgggggtaataaagaaatgggggagtagcttaagggacagtgtggtcaaggggtttttcttttattattaatggtttataacaccatgtttgtgtgctgatggcaaagatctagtaagacaaaatatggtgatgtaggaaagagatctcgtgtgcaaggaagaagaatcacttgttattcttcggcttatcaaactgcagaataggggctcagggcctggaaactaagaattttttcttagcgtttttagtttttgctttttttcttttatttgattattttattttttcttttatttcttttattttttcttttattttcttgttttattttatttgcttttttcttttatttctttttatctgtcacccaggctggagtgcagtggcgtgatcatggctcactgcagccttgagcttctgggcccaggcgatccttccacctcagcctcctgagtagctgggattataggcatgcaccactatgcctggctaatttttaaatttttttgtagaggcggggtctccctatattgccctggctagtctcttaactccagtgctcaagtgatcctcccacctcggcttctcaaagtgctgggatttcaggtgtgagctaccgtgcctggcctggattttgtacttttaatgggctgtaaaaaaatgaagaatatgtgagaccattgtggcccacaaagcctaaaatatttactgtctggccctttacagaaatagtttgtacagccctaatttatgataacttggaaagcagtgtgttggctgcagatactggtagatgggtggactagtggtgtgaatctgtggaagttatgttctgattatgtttcctcgtttgtatcatacacatttatcttacaattccaaggtaggaaataagttaaacaatgctgcaatcaaatttggtaacccttacctttcttgtgaaggggcacttgggcacttcctttcctttcctaattcattggaggaagaaagagaagttgggaagataacaattgatagcaagcttcttaaaacaggctcctgtttcttggctggatgcttccttttgtatattttagcaaatggaggaaatttgagcatagagtataagcatttgggatttataatttgggacttcagttttcatatgtattacaccagtagaaaaaaatacgaattttcttttcatgttacataatccaacagtgacttatttttatagaagcttctctactgccaaattcattttatacagtcttaaaaaattatcagtaaacaagctatatttgtgcataggaaataaatgcttattggttaatttatataatgctaagataagtgtgtgggtatgtaaagtagcacagtcattatggtaaacagtgcggaggttcctcaaactgaaaatagaattactatatgatccagcaaacccactgctagatatgtagccaaaagaaagtaaatcagtatatcaaagcgatatctgcactctcagatttattgcagcactatttacaatagccataatatggactcaacatgtgtccatcaactgataaattgataaagaaaatgtggtatatatacacaatggagtattgtttagtccccctaaaatgaaatcatgtcatttgcagcaatatggatggaacaggaagtcattataagtgaaataaaccaggcacagagagacaaatattgcatgtcttcactcaaatgtcagagctataaaagttgatttcatataggtggagagtagaatggtggctaccacagcatgagaagagaagcagggagaaggggacaaagagaagttggttaatgagtgccaaaaagcaattagatagaaggaataagttgtagtatttgatagtaaagtagggaaattatagttaacaatttattgtatatttcaaaatagctagaagagaagaaatgttatgctcccaacacaaagaagagataagtgtttgaggtaatagatattctaattaccttgatttgatcattacacattctatacatatatcaaaataccatgtgtataccatatatgtacaacttaaatatcaataaaaaacttataagtatcaggccaactaaaaaaaaggaataaaaataaatacctaaaacaaaatggagagaattttcatctgtttccaagaaggaaacctggcttaaaaaaaaattaaaaaatacagtcaaatcactattgtttagcttaatcaattgatggaaattattaaaggcaattggacaattaattccagtaataaatatcctaatcaagttaatgtatattatacattcaggagactgaatcctaatttagtgtaggtatatcttgaatgagtctttattagaaatttctaatatggcacatgaaattatgagtttattagttgtaactctttttgaatttaatgaatacttggacacaagtgaataaaaagcacgtgaaaattaaaaaaacaaaaatgaatcttagcttatgaagttattttcttttcttgcttttagttacaatttagaaagcagtatatggaatgtaggaactccatcaaggggacctctccagagatatggacactctcttgctttatatcaggtatggctcctgctttttaaattttaatcagattttgtttttgatagtttaccacaggctaaaaaatactaaatctcagatttatttcaaatatttaatgagaacaatagattatatggatcatgataacttgagataccacatactcttatgcttttagtaaaagaatagattttagaacaatcccccacatgacatgtaaagaaatgaagattgagtttttgtctatttatgcctagtcaatcacttaaaaaaattatggcgaaatacatgtaacataaaatttaccattttaactatttttaagtatagagttcagtggcattaagtacattgacattgctgtgtaaccatggctaccattatcttcagaacatttttcatcgggcaaaactgaagcaataacttctcattcccctcttcccttatcctcttgaaaccaccaatctacttttctgtctctgtgaatttaactgctctaggtacctcatgtaaatgggattgtacattatttgtccttttatgactgatttgtgtcccttagcacactatcttcaaggatcatccatgttgtatcatgtgtcagaatgtccttccttttgaagctgagtaaatattccattatatgtatataccacattttgtttatccatccatctgttgatggacacttagatagcttccatcttttggccattgtgaataatgtttctatgaacatgtgtgtacaactatctgagtctctgttttcatttttttttggtgtatacccagaagtggaattgctaaatcgtatggtaattctatgtttaattttttttttttttagcactgccatagtgttttccactatggctgcaccattttacatttccaccagcagtgcacaagggttccagtttgtccacagccttgtcaacacttgttattttctgtttttgtttttttgataattgacctaatgagtatctcactgtgattttgatttgcatttctctaatgattaatgatgttaaatatcttttcaagtgcttattggctatttgtatatcctctttggagaaatgtctattcaggtctttagccagttttgaattgggttgttttgtttggttgttgagttggaggagctctttatatattatggtattaacaccttatcagaatatgatttccagatattttccccctttatgggctgtcttttcactttgttgagagtgtcctttgatgcacagaatttttaattttagtttaatttaattttaattttaatttattttttcttttgttacttatgcttttgtgtcatatgcaagaaatcattgctagatccaatgtcatgaagcttttcctctatattttctcataagagttttaaagttttagttcttaggtttaagtttttgttgcattttgagttaattgtgtctgatgtaagggtccattttcattcctttgcacgtggatagccagtttccccaacatcgtttgttaaaaaagaaactgtctttttcccattaaatggtcttggcaccctagctgaaagtcctttgaccatgtatatgagggtttttttttctggactctctattttattctattgatctatatgtctgtctttatgctagtaccgtactatttagattactgtagctttttaataagttttgaagttaagaagtgtgatacttcctactttgtttttatttctcaagattgttttggctattcagggtcccttgaaagtctatatgaattttaggattaagtcttctatttctgcaaaaatgttggggttttgacagggattgtattgacattagttatttttatgtatttgtgggattcataaatttagcatgattaaaatgacaggacacttgtttggttttcattttgaatcaacaaaatttcatgtattttgtggcctttggctaggctgtctaaatatgaatttatatgttttctgtgctgttgttaaaaaaaattggaaagcatgggagcagtataaagaacaaactaccacctgtttatccatgcatttgtgtgttttaaaagtaaaataaaagtatttctatgtatgaaaacatatacctacattttttgccttgttttattttttctttatttccctttttgtaacagccttactgagatataattgatataccatacatttcactcatttaaagtgtacaattcagtggtttttagtatattcagagttgtgcaaccatctattgcagatttatgtaagattacagagttgtgtaatcacttttagaatactttcattacttcacaaagaaactttgtatcctttcggtatcaccccacacttcctcgtcttccctagccttaagcagtcacaaagctactttctttctctatatattggtccatgctggacatttcatataaatgaagtcatatactatgtatgttatgactaccatatttcacttagcataatttcaaggtttatccatgttgtagaatgtatcagtacttcttcattcctttttatggctaaataatattacattttatggaaatataccgtgttgtttattcatcggttgaggacatttgagttgtttccaccttttggctattatgaataatgctactaacaacattgctgtttaagattttgtctggacatatgttttcatttcttttgggtatatacataggggtggacttactgggtcaaattcactttttgaagaactgacagaatgttttccaaagttgctgcatcattttacattcccaccagccatgtatgagggtttctatttctatacatccttgccaacacttattagtatctgcctttttgattattgccatcctagtgggttgaagtattatctcattgtggttttgatttgtatttccctgttaactaatgatgttgagcatctttttgtgtgcttttggccatttgtatattgtctttggagaaatgtctattcaagtcctttgcttattttaaaattaagttgtccttttattattgagttgtaagaattcttcatatgttctagatacaagccattatcaggtaaataatttgcaaatattttcacccatttcgtgtgctgttttcactttcttgatgttatctttttaaacacaaaaaattggactttatcttgataaagtccaatttaactttttttccttttattgcttgtgatttggtgtcatatttaataattcattgccaaatctcaggtcataaagacttaacccaattttttttttcttttaagagttttatagttttgattcttgcatttagttctttgacctattttgagttaagttttgtatatagtatgcagtaagggtgcaagttctttttttttttttttgcatgtgactatccagttctcctagcaccatttgttcacaagacattttcttttgtctttgaatggtcttggtactcttgtcaaaaatcaattggccatagatgtgtgggtttatttctggactctcagttctattccattgatttatcccagtatcactctgttttgattacttttttttttttttttttgagacagagtcttgctctgtcacccaggctggagtgcagtagtgtaatcttggctcactgcaacctccacttcctgggttcaagcgattgtcctgcctcagcctcctgagtagctgggattacaggcgcctgccaccatgcccagctaatttttttatagttttagtagagatggggtttcaccatgttggccaggctggttttgaactcctgacctcaagtgatccactcgcctcggactttcaaagtgctgggattacagtcatgagccaccatgcccaacctatcttgattacttttgctttgcagtaagtttttgagaagtgggagtactccagttttgttcttttacaagattgttctgatgttctgcatcccttgcaatttcatatgaattttggaatcaatttgtcagtttctacaaagaagccagctgagattttgatagggatcatgttgaatctgtagatcaatttggagagtattatcctcttaatcaatttggagagtattatcttaacaatgttaagtcttcagacccataaacatgggatgtcttttcatttatttatatcttttaaaaatttatttaaacaatgttttgtaattttcagagtataaggtttggacttcctttattaaatttattcataagtattttattcttttagatgcttttgtcaatgtaattattttcccaatttcatttttggggtgttcattacaagtgtatggaaatacaatttactttttgtacattgatcttatgttctgtaatattgctgattcatttattagctctaagtgctttttaaaaaaatttttaggactttctatataccagattgcatcatctgcaaatagaaatattttacttcttctttccaatctggatgtctttatttagtttttgctctagctggaacatccactacaatgttgaatataagtggcaaaagcaggcatgcttatcttgttcctgaccttagggaaatgtatctagtctttcactgttaggtataatgttagctgtgagtttccttaaatatcttttgtcaggttggaaaaatttttttctatttctagtttgttgaaataatgataatttacatcatttatgtaccatttatttccatcatatgcatttgaaataatttgtataatttaaaagttctacaaggatttaccaaaggtgaactgaaggcatgtggtgtctgtctatagccattagaaatggtaacagaggtgtactctacatgatgcacaaatgtgatatgtctttttggtgaagagcacgtgatgaaaacagtaaataactgagaatagcacaaagctactagggactcagatgattcaaatattgaagactatgagtaatattaatcaacaacttagtttgttatcttcagttatatgggaggagtacattattctttgttataggactacctcacccttaaattgtaagttctttattagcttattgcattttccattcttaaagcagtagtttagtgttctcttactgtatgacaattaaaagtatacttaattgactacataatgtgatagttaaaaaatatatttaaagtagctttttgaaagctttgctgtttccccccctttttgtatataaaagcattagttgtcattattcatgtgttctcattactttttacaaatgagaacaatgccttatgcatgttgtgaacaattactaaaattttatgtaaatttaacctttatttttaattaatatgtgttaagatataacattattttatctattaatatatgtattttaatttacaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctaataaaatcttcatatgaatttagtcaaaatggtgagttatttgagattgaaattataagctgataattaataatttttaatataagcttttttgattatgttagattttgtcctttaatatttaagcttacctttttaaccaaatgaggggaaatattacttaatagtctcattttctaagatttgtgaattttttaaaaaaatatgtgaaattccagtaggtggtgctatttctttggattttatttatgaacgaagtactgaaactatcccagtctctttactatgcattgcatggtttcaggattttttattttttagcattctatttctaatcttactgctatatctttatgtatgtattacttctttaaagtcagcttctcaaggatagtctgctggcttctataagagattattatctgttatgtgaaggtgaaggtgtctagggcaatctacatgtgagtttttgtactatacctttactccattttgtttttctggtacttcatttttttgaattatttataacatttttaaaacagtggtaaccttctttattgtttttagtttgtttacaaatatatgccctatggtggttattcagattcaagaaaataattcttttctggctctggccagtatgatgaactcaaattcttggctcttttgtgtatggacaactatatatacaactatttagagtccttgtgcagtcttaatgagaaaactcatttgcagaccaccattagcaagagagtacttgtatgctcagaggaagactccccttcgaaatactccactgtttcccttgcagtcctttcaagtgatggctgtttttgtttacatattctcagtacagctgggtcaaaagtgggttacatatcccctttacttcttattgccatttccactctattctcaattcctcctcctttaaattgcctggctttgactcttacatcatcagaatatatcacctattacttcaccttcctgcactcatcctttgctctcagatggctgtgttttatttcttgaggaatttagcttctggcttactgtcactgtgtccagaatacataaggcaaatatttttatgttgtaaatatgcacttaagtacttctcctacctggcctgtcaatttcttgatctaccaaagattttgttttccatcctccttgagccactctctccattgttacgttctagaccttgttattccagtacaatgagtccataatttccatatgaaatatcttacttttcaagtcccactgatctctccagcttactgtttctaatgcccacactctgacaattctttgaccttaccagagcctttagtctgttgagactatcagtttttccactatctctcactctttttttgtccatatttctaaccctacctttttaatccatacttctagccctacccatacttctaaacgtacctagctttaaatttcataattactgttctcaagttgtttttttttttttatgatatccggtacttactcagctgtaagtttataattactcatgtcaagttggcccttaatgacatctggaacttctgccagtgtagcttggtctcgctcccagctctcctggatgactatttcataccttttcctctctcctcaagtttcaaacacttccttctctatcatcactcgcaattgatgaccttagttcttattttactgagaaaacagaagtaatcaggagagaatggctattgatgagaacacgttggagggtgatggttaataagcaatgctacattgaataagcttgcttacatacattattgtcataacaaactcatgacaacgttgaggcagatgtgtggctgagttattccaacttttgaaatgggcccaggagtttttaagcaagagttaacagatgttctatgtagaagggcagttttcttttctgattttgttattaatttttggttttattatagtgctcaggaaatgttggtcttatttctactttttaaatttattgaaattttctttgtgcctcagttttcacaaatatttgataggcacttgagaagaagataaatccaataatatcaaggtatggagtttgatattatttatttataaaatcgactttattgattatattgtttaggccttctgtactgacttagtattttttgttcttgatttatcttgctgtgaaagtggaagtaaaattttaaagtgttagtgtatttttcatatttctccttatatattctggaatttatgttttatagaagttgctattacaaatattaataattgttatgtgcttattgtaaattgtattacttactattataaagtggtttgtttaatgttttcttgacctgaattctacctcatctgtcgttaatattgcccttgttttgtttttttggtcagtcttttcctagtatacctttgctcatccctttattgttattattgtttagtgttttagaatcactttaaaaaaatgtatttcttgcatacgagagagttgaattttgctttgtgattcctgttttttttttgtaaattttctgtacatgtcttgtattttcaaaagtcattcttgcttttttgttgatttgtttttaattatagctcttctcacgtttagggccctccttccccttaactttattttatttttttgtggggatgggtgtggtaagttttgagatctgcttccattagtttcctctatgctacttgtttctcattgccctttcagcatttttgtggctgcttctgtttagctgttttggtttcacttgatttttgtacgttcatacctaatctagactttatgaggaattttttttttaccctcataatttctctggaaatgtaattttcttttcctttcacttcatctactttccccatgttttccttttgttttctatttcttttccagggagaatgggggagattcagaactaaactgttaccacatttgtccttgaaacacaggttttgacttttgaaattttaaaatgagtacttaacttagtctaaagttaagcaatactcttattctttgatcaacctccaatttataggatactgttttccactgttttagttatttttgttttgtttcaaacacaatgataattatatcattttataatataaataaattaaaaataaacagtaagtatatcatttatttacaggggtcagcaaaaggcatctataaatgaccagatagtaaatatcttaggctttgttggtcatacagtctctgtcacaactaattaactctgccttgtagcctgaaagttgccatagacaatagataaacaaatgggcatggttgtgttcaataaaaatttatttacaaaaacaggtggtgggctagatttagcctttgggccttactttgcctacacttgctcttaagagaaagagtatgcttctagggccctagtaaccctgatccaacttaaattaaaatttggcatatagtttttttttggacattatatatagggaaaattcatgccccaaagtagcctgatatctagtaaatggcccaaagttcccagggggaatagttgtttcgtatatgtggaaccaaggctgaaatagatgctatctatctgcctccacggagcatatttttaaaaactcactttttcattgaggatgtacactttcaatgatcttgactttacatagatactctctaatcttatacctacatgggtccaccttcaatgttggccattaaaatggaatctctaggccacctgattagtatatgtcatccttactgaatatagtttataattcacagttggcagaatatatttcgtgtgcttcatcgtttcctttattgaacgtttgtcccactcagccatcagacataatggtggttatgctttccaaggatggctaggaaagtactatgggtttattctgatcaactattagtgataaatattgatataggttgttagctgatatattaatctcctggtaggtttttgtttgatttgggataatctgattacagaatgccaattttgttttagataatctaaacatatttttatattgagtttcttttggcttattctacaaccaaaatactatgtctaaataaatttatctgcagggtatttttggcttgatttttgtcttactaactgcattacttgtcaggcatacttaagaatgtagtgtaagatgaaaatgggaagaatacatgattgatgagttttataagaataatagataaaccatgggcagtttcacattctgtgaattattgaagtacaaagcaaaacccaacaaattttttataaaattatttcttaatagaaaaattaatatcttactttacttattcctaaggcattttgaatttgctgcttacatgttgaaagtatgtggtgtcataaaataatctatagtactttcaaagaaaagagtacaaaatgatgggtaaatgtagtttaaagatgctgtcagaataattaaattcaccacactgtcttccacagtggttgaactagtttacattcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcatttcttcatgtgtttgttggctgcataaatgtcttcttttgagaagtgtctgttcatatccttcacccactttttgatggggttgtttttttcttgtaaatttgtttgagttctttgtagattctggatattagccctttgccagatgagtagattgcaaaaattttcttccattctgtaggttgcctttcactctgatggtagtttcttttgctgtgcagaagctctttagtttaattagatcccatttgtcaattttggcttttgttgccattggtttagtgttttagacatgaagtccttgcccatgcctatgtcctgtgaattgttttggctgcatgttgtaaataaactttatggaagaaagaacagaaagaggatagttaggaagttgttaacggtaatctgggccaaaaatgatgatgagaattagtcgatctgttggattttttaaaaaagtagagccaatagtatttgctgagggtttagatgtagagtgtgagataaaagagaggaaccaagggtgattccaaaattttgggcctgagcagctggaaagatgaaattgccatcaaccgacatgtagtagattgtgaagcaggtttggggcaaaggtgttttaacgatgaggagttcagtttggacatgttatacgtgagatagccactagatgtcaaagagaaaatgtcaagcagacagttggatatatatgttgctataggtactcttttttttaaaaaatttatattctttttctaagaagttttagagcaggaattctgcagtatacctccttatgtgtacactttctagtaaagtgccatattcttactggagtcctagagagaaagatctgggctgaaggtgtaaatttgggagttcttgggagttcttaaagccaagagactagatcagatcactaatgaagtgggtgtagataaaaaggagaataaaaggattgagctatagggtccccgaataataagaggtaggggagaaaaggaagataagcaaggaagagtacggtgaagtgtaagccaagtgcagaaagaatattaagtgggaaagtaatcaacggagccacattctgctgatgcctcaagtacaatcattactaaggattgatcattgaatttagcactgtgcagtcattggtgatcttgataggaacagtttctgtgtagtgatggggtgaaagtctcacaatattggatttaatagggaatgagagaagtagaagtggaaatgatgggtggaaccagctctttcaaggaaatgtgtttgaaaaggaaagcacaaagtgagcagaaactggcaagaaacttaggatcctttttagcttggatttttacagaagcagacaatgagacaggatttcagtgaaataattctatttgggaaagtgtaggtaacactgttaggggagttgatacaaggacgagaaggcagccatttaaaggtccaggctttaattgacacataatctctgaaattttctttaactattaaccctgtcagttgtcagttgatgtgtcccatggactatgtctccaaaacctacccattcttagtagagaacctatccatttttgctagagatggggtttcgccatgcctgtctcgcactcctgacctcaagagatctgcctgttttgacgtcccaaagttctgggattacaaagtactgtgtcatccagtgtggcttgattaatatgaaaatgtttatagagataagacaacagaatacttaagaaaatagctagtgtgaagcatacacaaataaatcaggaagggagctgtgttttttttttttttttggttttgtttttttgttttttttgtttttttttttgtttttttttttttgagacagtctgactctgttgcaggggctggaatgcagtggcacgatctcagctcactgaagcctctgccacctgggttcaagtgatcctcccacctcagcctcccaagtggttgggattataggcatgcaccaccacacccagctactttttgtatttttagtagagatggggtttcgccatgcctgtcttgaactcctgagctcgagtgatctgccttcttcgacctcccaaagtgctgggactacagacatgagccaccgtgcctggccaaggacgggaaattttttgtgagaacatcctagagtacaacttctaaaagtgatgtcgggttatcaagtgcttaggtgtgacagtgacaacaagacttatattcaaaattgttggaaaaatccagaaaatgtttaatgaagaaatcagcttgcagtaaaggttccacatgcttttgtttgtcacagagtggaagtggccttcataattgtataatgatgaaaagacttcttaatccacagctttatttactgcatttttcattttctggaagtagttttattttcctctaagctcctgtgtccttttgtttttaaatgaatatgacacatgctacaatttgaatatgtcccctccaaaattcatgttgaaacctaatccccattgcggtagtattaagaggtggggctttttggtgtgtgattaagtcaggatggctctgctgtcatgagtggattagtgccttacaaaaagtgctggagggagctagctgggtcctttttgccttccatccttccaccatgtgaggacacagcattcttcccctctggaggacatagcaaacaaggcaccatctggaagcagagcgtagctctcagcagacaccaaagctgccagcaccttgattttgaaattcctagtttccagaactgttagaaataaatttccattgtttattaattacatatatgctgttttttataggtactctttttttttctaaaaaaatttatattctttttctaagaagttttagaggaggaattctgcaacatatctcctgtgtgtatactttctagtaaaggggcatatattaaatgcttgataaatatttgtggatgaataaatacgattttcatcacactttccttaaaagtgtgaatctgtttcttgactttgtttttagtatattaaccaaattatttaaattgtgtactatacgtaattattattctccttctagtggtgactcataacatgctgtgcttgatgtcctctatttgtctctccacatctaccttttatttttttccatcctgtttccatgccctctggcttccaggtaggctgagccagtggtggtagatctgatggtgggagatgagtggggttgtggtattttattccaccaactttctccctgctggataaccttgggttagttgtgttgctttattgaaggctgaactgtcaggtgtcctcatatagctattttctaggaattctggaaacactccctcctcttgcttttttaaggccaaggggtggtaaagtcttcctgttgtggtaggtctcaggatattgccctggtcatacctttataaatagcctttattagatactttataattgttttgatcatattatttatttcctgtcagcaccctggctgatatagtagctactattggctttttagagattcaaatataacttttgaccaaaatgatccttcatatgttcttattctggaagttgagaggaagaagtgtcttgtgggaggatttcacactttattagtggataaaaatgttggcagaagtataaacatttcagaatagcatggaattaggtccttcagtccatttctatgcttatttttgaatttttaaattttaatgtcacatggtcatctttaatgttgcattttctcttaatgtgaaagattaatatatttatcatctttcaagagtagctgttccagttttttaataagcagaacccttatttatgtatttcttcttatttattcaagaaaacctttttgttggatattcttttaaatttctttttgaattatgctaactcagactcaacttttttttggttattatgctatcaacgtagaagtaatcattgtcttactagcaaaatacctccaaagtgtatttgatgggaggatatttatttttttaaaagcccatttgctgtattcctttaagttttctctttaaaatcatgttaatttaaaaaaattgttgatttttttcaacttctccattattctgaaatccagaaattcttattgtatatttgtttttaaaaatagctttatcacatatacatgtgcatgtcatctggtttgcttatttttgacctttataaaaaggttgtatttatgccattttctcaggctttctttgattttgtttatcacgattattaccaagattcatccatgtcattatatattgctgcagttaacttctttatatttctgtattttatttgttgtataactctaccacaatttatttacctatttccctgcttttgagcttttggatttggtatctagtaaaatttacccacagtagccattttgagacatatcctgataaactattgcattttaagagataaagaaaaaaatccttaggattttccagcagaaagatgaaatatcttacaagggcaagagattagactagtatcagatttttcaaaagcaacctacagatcaaggcaaccatggaacaaaattttcaagacacttcagaaagtatagaccaagggttttatgtcttgccaaattgtacctcaagtgtcaaggctatcaaaaataattttgaacatagaaaaactaagttaatactgtatgtgtgtgcccttacctgagaaatttatatactagggtagaggtttgcagatgttttttggtaagggttcagatagtaaatagtttaggctttgtatcctactaaattctgttgactctgttgtcactactcagttcttccattgaaactgtatacaaacagtataaattgcataaaagggtgaatgtggctatgtccaataaaacctgatttacaaaaacaattggtggagttaatgggctgtaattttccaatccctgtcctggagaatgagcttcacctaatgaacagataaatgggaacacttcaggtaaaagattgatggaaaacatttcccatacttaattttagagctaagactaaaataaaggtaggaatatgtgtagacaactaaatgtgcaaatgttacatgttttgtccaagtagaaataatgcagttaaaaatgggagaagggagaggaaaggggaaatcagagataagaacattgacagctgcatatgtaatagataggaatcaaaagatgccatttaacacttgatattccatcaaggtctattggacccaattttaatttttagtttgttttctgagcaggcctaactatttgcgaagactattattttatacattttattctttcttagaagtctttcaaagaacaaagagaacatttacttgttaaaaaaaatcagaataaaatattctgtctgtgattaccagatgggtctgttgcattcttttaaaaatgaaagatacactgtggaatttaaatgttgttattttctgtgttctaaagcattttgctatttatcattttaggaactaattcattacttatcaattatttccaactatgctaaaaattaacaataaaacagaagttttttagaaagatgatgccacagtgaaaaaaactgtcatcctttagttgtattattgcggtgcccgaagtattttattacctttaaagaaggcatacaagaagacaaagtaccatcattgtagtccgcttttagtttttgttgaacacagttgagaatttaaaatttttcattttctgcccatactagtaaaaagttgaaagatctttcgcagtaattagacaaataagaagatgaatgcaaagagacagataagaatgcaaagagacagatggtaaccctgtaaactctggtgagtttacactaaatctcagactatggatcttcaggaaatgatatcctaaatgaattttttcaaactcttagattcagtgagtgaacaatacatttttattttttattatgtttatatgccccaacactttaaaacaaagaggtttgctatatttaaattctttttggaatttgcaaaaggtagtttttgactgacacttttttcttgtgtaaattacttatgatgtgataaagcaactaaaaggaactattgaatcatgataaatgctgattactattgttctaggtatactgaggattaaaactgacagaacagataataaaattaggtaagaaagatgagaattaagggcactatgaaagatacatacacaaaggaaaacactaacaaagatataaacgttcttacctaccaaaagaaataaaagcaaagaaatatcaaataggaaaaaactcagaaatatgcattataatacatacacacagtaattatgacataaaattctgtgacagagttgagattcaccataatatcagtacatgggaatgggattaacttgtttattaaaagaaaacatttcaacttgctgcataaaacaaaacccaaatctatgcttgatttaggagacatttacaacatattgatgcagaaacgatgaaaataaaggaacagagaaagatttcataggtgaatgattacagtaagacagggaatatcaaaacattatacaagaataccttataattactaaaacccacaattcaccacaatgatatgatatatattagaagaatattatctatacaccagacaacccagcaaccacctatagaaaacagaaaccacaggcagtgaagagaaacagtgtcacttcagtacaaaacaggtcagtcattattgtcaatacacgataggataaaaaataagaaaatatctaaaaaaatctaaacaacataactaataaagttgaagttaaggatgtatagcgaacaatacagcccgattatagagaatgttgtcttctcaaatgcacatggaaaacccacaaaaattgactgaatatatatataaaaaattagtagtttcccaagaatggaagcattgaaaataaacacctgaatattaaataaaatctttctattgggtgaatggggaaatacaaggaaaaattacagaatttctgaaaaatagtgacagtaaaagcaacacatataaagatttatgggatacatttagagcagttatcagaagtatatttataacattaaacaactctattaatatgaatgaaaataaatgcaccacattcccaattcaaaaagctagaaaaagaatagctaaaccaacaagtaaagatttttgcataactttttatataactaggaggagaataaaaataaaagctgaaattaatgatgtaagaacagaaaaacagattaatttttttgaaaaaaacagagaagccagcagctcatttaatcaagaaacaagagagcaagcacaaatacacaaaacaagaaatgacaagggagaaataatattgataggatattaaaatagtagactatcttgtacaacaatgcaattaaatttgaaaatgttgaagaaatgaattatttcatagaaagtagcaatttttcaaattgaacccagtaaatataaaaaatttgtataaagcactttccttagaaaaagtggagaaagcaccaggcctagatgataccagagagtaaatttagcaaaatcttaatagctggatagtctcaatgctatgtaggttgttttagagaatgataaaggaaggaaacttccaaatttgttttataagggaagtataacattgccacttaaacccactacacagaaatggaaaatttacatatgtatatgattaaaaatgaaataaaacctttccccgttaaatatcaacacaaaattctaaataaaatgaacactccaacacattcttttcttaatgtgtgttgagttttattaatatattttataataagcatccttggatgcctgggtatacatcccatttaataataaaatacacattaatagataattaagtataattaagtgggatatatagccaagcatctaaggatgactattatgaaatatattaataaaactcactatattagtaggtcaaaggagaaaaatgatattattttcattggtattaaaaaaatcacatttctaataacgcttgagaaaatgggaatggatggctactgtatgaacataataaatatgtttcaatcccaaagccagcatcttatacttaataagggaaataagcatttctattcacttcaagaacaaaacaagcgtgcacactatctccagtgcaagattatatatatatatacacacacataaacacacacacaactatgtatataactatatatacacaactatgtataactatatatatatatacacacaactatataactatgaagtagtaatatatatacatgtactactttttgtgtaagggaagtaaaatatagttacacatgctaatttgagcaaaaatgaacacaggaaagataaaccagaaaacaagtatgttggttatttacaaggggtggtagagaatggtatggtaaagatatgacatgaaagtatatttacctgtgtttactcttttaaaaaaatagtcttgacttagaaacattgatttttagaatcatattaatcatttacatattgaacaattaaataaaaaaggaaaggaagaaaaaaatcataaaacaatgtaagctgaaacaaatgaacccaactatgtttcaaatgaataggataatcattctgaaacgggatgaaaagaactaatgcaagtgatttttgaacacagtatttgactatgtgctctcagtcgaggtttagatgcgaagaaggactgcaaacaaatctttgaggtttgttttttgaaggtttaggtgaagcaattctgaaattattttagatatatgtttagactaaaaaataagtaaatatatttttttgggaaccaaagttcttcatgtggaagacgagaactgcagctatgaaatggggaagtcaaggaagaatcctggcctggatggattgcaattggaggtatcagtatgagtttatggttacttagataaatagatacatggatatgtagatacataaataaataagttaatacatagatgtagattcttctgaaagggcccagaagctaagacaccccagtagtagtgagcacactgagcactcgtattcccagatctggtttgtaatatttcctatggaaagaaagcagggctccttggaggagctgattctatgactgtgacaaggaaagtaaagataagccaagtacatcttgttatatcaaattaaggaagcactcaagaaaacgatgggtcatgtcaaaagaacacaggaatcaccttctaggggatcccattggtaaaacatgggacaatttgagcattaaaataatttaagaaagaaatacattaaaaactattgaaaaaataggaatgcataagcttacactgagagtagacagacaggtacaaatacagaagaagggaagcctctacataggatgcagactgtcatagctggagttgaaaaatcattttgcaaaagtcatagtaaaagttgggatgggaaagaatcatcaatggatgttaaatctgtgggggtgggtatgaaatttttttatgagatatgcacggcatttaagtctcccctacagattgctgataaggtgcgggagaaaaatcgtaactacatagtagagaaacctgtcaataacttgtctgagtgatcaaaattaacatcacaaactaaggggaattggacactgtgtgcctttgtatataatacctacagaaagagacattacgtgtggtagagttctgcaaaccagttctgtaaaagttgaaatagtaaatattttgggctttgtggactatacagtctctgtctcatctattcagttttgccaattctgccattatagggtgaaagcaagccatagataagtaactgagtgaacagaatgaagagacattttatggaaagggggaaaatattcacaaattatacatctgataagagattaatatccaaaatgtataaacaacaacttaaaacaacccgattaaaaaatgggcaaaggatctaagtagacatttctcaaagaagacatacaaatgataagaaacactggcgaggatgtggagaaaagggagccctcatacattattggtgggaatgtaaattagtacaaccatgatggagaacagttcggaggttcctcaaaaaaactaaaaatagagttaccaaatgacccagcaatcacattgctagatacatacccaaaagaaagaagatcattatagcgaagagatatctacactcccatgtttgttgcagtactattcatcatagccaagatttggaagcaatctaagtgtccatcaacaggaatggataaagaaaaaatggtccatatatacaatggagtaccattcagccataaaaaagaatgcaaccctgtcatttgcaccattgatggaactggaaatcattaagtgaaataagccaggcacagaaagaaaactgcatgttctcacttatttgtgggagctaaaaataaaaacaaactcatggagatagaaaaatgatggttactagaggctgggaagggtcgttggtggggatgtgaggatgattaatgggtgcagaaagtatatatacaatgagtaaaatcctctatttgacagcacaacagtgactatagtgaacaacagtttattttacattttaaaataatacagtagaattggattatttgtgtcaaagaaatgaatagatgtttgatgtgattattatgcattgtgtgcttgtttcaaaatatctcatgtaacccataaatatatacatctatgtgaccacaaaaattaaaaataaaaaaatttataaagcaaaacataaaaatggccaacagatgtatgaaaacatgctcaatattactagtcatcagggaaatgcaaattaaaactacaatgatctatgatctctcccctcacacctgttagaatggctgtaaaaaagacaaaagataacaagtattggtgaggatgtggaaaagagggagtacttgtacactgtttctgggaatatttttttttttttttaacaaaaatgagcagcagagtaggtatgaccccacaggacatagcttacccacccctaccttacagtattgtgactagaaatgcctaacctgaagctaatcatgaagcaatatcagacaaacttcaaataaagaatatgccatctaaaaagagggatggatagctttattcttcaaaaatatccatgttatgggagacagagaaaggttgaaaaattgttccagattaaaggaagcttacaagacatgacagctggttgttgaccactggtgcacaacatggtgacaacaaatgcatgagaactggtgatcccagactggattctatgctggatgaaaaattaaaaaatgctatgaaggacattatgtactcagttcacaaaatttaaatgtatagatacattaaagtattgtacaaatgttaaatttcttaaagttgataattgcaatatggttatgtataatagaaagagggtgcttggttttttttttttttttttttcttttttctttttttttttgagatggagtctccctctgtagcccaggctggagtgatctcggctcactgcaacctccacttcccgggttcaagtgattctcctgcctcagcctcctgagtagctgggactacaggtgcgcgccagcatgcctggttaattttttaatttttagtagagatggggtttcaccatgttaaccaggatggtcttgatctcctgatctcatgatccacccacctcggtctcccaaagtgctgggattataggcgtgagccaccgcacccagctggttcttaagaaatacacaccaaagtattaaggacagtaagaatgatgtatacaactgggagagagggagggggagggggagggggagagggagaaagggggagggagaaagggagaggaagggagagagagagggagaaagaattaatgataaacgggaaaaatattgacaattagggaatctgaatgacaggtatatgtgtatggggagttctttggctattgcacttttgaaattatttgcaaataaatgtgaaaatagaagaagtagataaatgttttttcatatttggttatgtggaatatatgtttaactgaagattttaagaattcccttgaacttgctgtggcagtaaaggaaatgtcagtttgtccttttttgttatacttagaattacggcttttagggaatctacaaatctcagaggggaattatgtggatggttttactaacttggaccataaagctcttctgggttagtcctgtgggaaatttatttcactttagtttagcaatacctcataaactttctaagaatctcaatgtgagtctcaaggtgagtataatattaatgttttgctttagtatttttcatgctttaagaattttggaggtgtagttgggaagccataattaatgtcatttaatgttaacttttttccttttgatctaaaaatcattagattttttcagaaaggtatttttttaatataaatttattgatactatgagtttctcctctgctcttaatatcacatgtttttaaaaattctgtggtgaattttaagtgtaaattggacattgatttttagcacactggtgtctgaaaatagatccataaaacagatgtattaagtggtgggaattagggatttttaataggagaaatctccagtttagaaacaattcaatcataggaatcacagaaagcaaaattttattatgtgttgcaattaggcttggcatttgtggtagagtttcatttgtgcagacctttttaggaataattaagtaaaatgaaacagtatcaatataatgagtaaaatacagttatgccatgcacaatatttcaattaatcacagactgaatatatgatggaggtctcataagattattctggaactgaaaaattcctatccctggagatgatgtagctgtcaaaatgtcatagtgcaatgcattgctcatgtgtttgtggtgatgctggtgtaaacaaacctacttcactgccagtcgtacagaagtatggcacatacaattatatatagtacataatatttgatgctgataataaacaactatgttagtgatttatgtgtttactatactttttattattttagaatatactttttctacttacaagaaaaaaaaactgtaaaatagccttaggcaggaggtattccagaagaaggcattattatcataggagatgagagctccatgcatatgaatgcccctgaagaccttccagtgggacaagatgtggaggtggaagacagtgatactgatgatcctgactttgtgtaggcctaggctaatgtgtgtgtttgtgtttttgtttttagcaaaaaattttaaaaaataaaaagtgaaaaaataggaaaaagcttatataataaggatttaaggaaaaaatttttatagctgtaaaatatgtttgtgttttaggctgttattacagaaggatcaaaaagttaaaaaattaaaaagtttataagtaaaaatttatagtgggctaaggttaatttattattgaaggaagaaaaatattttaaaaaatttagtgttgactaagtatacagtgcttataaattctacagtagtatacagtaatgtcctaggccttcacattcactcaccacttacccactgactcatccagagcaacttccagtcctgcaagcttcattcatggtaagtgtcctatacaggtataccattttttattttttacaccacacttttaccataccttttctatatgtttagatacacaaataccgttgtgttctaattacctacagtattcagtacaacaacatgctgtacgggtttttcgttcaggagcaataggctgtgtcacacagcctaggtatgtagtaggctataccatttaggtttgtagaagtatactctatgatgttcacacagtgatgaaattgcctaacagtgcatttctcagaatgtatcctcattgttaaggaacacacgactttatcattttagcaaactgctttgccattgtgacaaatgctactgttaaaattgtatacgttttttttacttactaaatgtttttagttttgctaagtgaattattaaaccatatgcttttaagctatttaggaactacaaaaatattatacatatccttgaaaatttgcactgactatattaaaaagttttagtagatgtgcattcatattcagaaaattcttatttttctgtatctgcttaacattctttcactgatggatatatcagtgccttaaaaggcagccattctattactttatatattttaaacattttatttatttggaagaaatacgcactccctataatttgtacttataacattttttatttttgattattatgggcacataatagttgtatatgtttatgagatacatgtgatgttttgatacagtcatacaatgtgtaatgatcaaatcagggtaattgggacatccatcacttcaagcctttattattttttgtgttaggaacatttcagttctacttgtttagttatttattgcttttgcatcaacctaataaaaatatacaataaattattaactgtagtcaccctattttgctaccaaatattcattctatctgtatttttgtacccattaaccagcctcactttatcccctgctctctgctacctttcctagcctctagcaactatcattccactctttatagtccataaattcaacaatttttgtcttccacatgtaagtgagaatacgtgatatttgtctttctgtgcctggcttatttcacttaacattgcccttcagtttcatccgtgttgttgcagatgacaggatttcattcttttttaatggctaaataatgttctgttgtgtatatgcatagaattttcttctcattcatctgttgatggacacttaggttgctttcgtagcttggctattgtgaatagtgctgcaataaacatgggaacgcagatatctctttgatatacagattttctttcttttggatatatgtccagcagtggtattgctggatcatgtggtagttctatttttagttttttaggaactccaaactattcttcatagtggttgtactaatttatgttctcaccggcagtgtatgaggattctcctttctccacatcctcatcagcattattgcctgtcttttggataaaagccattttaactggagtgagattgtatctcattataattttgattgtatttatctgatgattagtaagtattttttcatatacctgtttgccatttttatgttgatatgattaggctttgtgtccccacccaaatctcaattgaattgtaatccccatactctccacaatccccacgtatcaaggaatagaccaggtagaggtaattacatcatgggagcagcttcccccatgctgttctcattatagtgagtgagttctcatgagatctgatggttttataagtatttcatagttcctcctgtgttcattatcctccctgccaccctttgtagaaggtgccttccttccccttccccttccgccatgattgcaagttccctgaggcctcctcagccatgctgaactgtgagtcaattaaacccctttcctttataaattactcagtcttgggcagttctttatagcagtgtgaaaacgggctaataacatatgttgtcttttgagaaaagttctattcagatcttttgcccatttaaaaataagatctttttttccctattgagttgtttgacaactttgtatattctggttattaatcccttgtcagagggtactttgaaaatattttctctcattctgtgggttgtctcttcactgtgttgattgtttcctttgctgtgcagaagatttttttagcttgatgtgatgcctttgcccattttttgctttggttacctgtgcttttgaggtcctactcaagaaatctgcccagaccaatgtcctggagtgtttctccagtgttttcttctagtattttcatagtttcatgtgttagatgtaagtctttaatccattttgattttattttcgtatatggtgagaggtaggggtctagtttcattcttctgcctatggatatccagttttcccagaatcatttattgaagagactgtcctttccccaatgtatgttcttggcacccttgtaaaaaacgagttgactgtaaatgtgtgaatttatttctggagtctctattctgttgcattggtctatatttctgtttttatgccagtacaatgctgttttgactattatggctttgtaatataatttcaagtctggtaatgtgatgcctcctgttttgttctttttgctcaggatggctttggctattctgggtcttttgtggtttcatataaattttaggatcattctttctgtgaagaatgtcattagtattttgataggcattatgtttaatctatagaacctttgggtagtttggacattttaacaatatttttccaaatccgtttttttgtgtattctcttcaatttctttcatcagtgtcttataatttcaattgtagagatctttcacttctttggttaagttaattcccagacattttatttcacttgtagctattttaaatgggattacttttttttggtttctttttcagattgtgcactgttgccatgtaggaatgctactgtttttttgtatcttgattttgtatccctgcaacattactggatatgtttatcggttccagtagtttttggagtctttaggttttctaaatataagatcatataatctataaacaaggaaaaacttgatttctttctttctatttaggatgtcctttatttctttctcttgtctaattgctgtagctaggacttccagtactgccttgaatacaagtggtgaaaggatcctgtctttttctagatattagaggaaaggctttcagtttttccccatttattatgatactagctgtgggtttgttgtatgtggcttttaaactattgaagtatgtttcttctgtacccagttttttagtttttatagtgaaaggattttgaattattgaatgcattttggcatcaattgaaatggccgtatgatttttctcttcattctgttgacaccatcaggtactaggcttttgtttgatgggagacatttcatcagtgcatccatcttgctatgtgttattgacctactcaggttttgaatttctccatggtttaatcttggtatgttgcaagtaatgtatctgtttcttctgttttacagtgtattggcactttgtctcctaatagtctctaatgattctttgattttctgtggtatcccttgtaatgtctcctttttcatctctgattttatttatttaggtcttctttcttttttctttgtctgatttaagatttgtctatattttcatcttttcaaaaataaacttcatttcattgaccttttgtattttttattattgatttaatttctgctctgatctttattattttatttcttctactaattttgggtttggtttgctcttctctttgtgttctttaagatgtgccattaggttgtttatttgaagcttttctatttttttaatgtaaggatttattactgtaaacttccctcttagtactgcttttgctgtattctttaggttttgatctgtttgtctccattttcgtttgtttctggaaattttaaaattttcttctgaatttcttcattgaccgaagtggtttttttagaagcatttccatgagtttgtatagttttcaaagttcctcctgctattgatttctagttttattctgttgtggtcagatgagatacttgatacttgatatgattttaattgttttgaatttttgagacatgttttgtgtcctaatgaattgtctatcttggagagcattctatgtgctgaggagaagaatgtgtattgtgcagctattagatgaaatggtctgtaaatgtctatttggtctgtagtgcagattaaggtctgatctgatgtttctttgttgattttctgtctggatgatctgtccaatcctaaaaatgtgctgttgaagtcccaagatattattgttttggggtcttctctctttttagatctaataatgtttgcattatatttttggtgctccagtggtacatatagatttacaattgttctatcatcttgctgaagagactcctttatcattatgtaataaccttgtctctttttgcagtttttttctcttgaaacctatttatgtgatacaagtatagctactccttcttgctttttttttgtttgtttgttgccattggcatggaatatcttttttcatccctttattttaggtctgtgtgtctttatgggtgaagtgtttcttctaggcagcatgtagtggggtcttattttttatccattcttctatgtcttttgtttggagaatttagtccgtttacattcaatattattattgattcgtaagaacttattactgccattttgttgtttgttttctggtcattttgttggtctttcttttttccttctgaattcctttgtataaaagtgatttttttttctggtagtatattttaatttcttgctttttattttttgtatatctgttttaggtttttgttttgtggttaccatgaggtttgcaaataaaatcttataaccagttattttaagctgatgacaaattaattttgattacaaggaaaagaaaaaaaacaaaacaaataagcaaataaaaaactaaaaaagctctatacattctttttggctttggactttttattgtctatatttatatctttttatacagtctacctgaaaaagttgtggtagtttttagttttgattggtttgttttttagtttttctactacagatatgagtgctttatgtatttcagttatagtattaagcgtattctctgtatgtttgtatatttactattgccagtgagttttatacctttagatgatttcctgttgtttgttaatatcctcttgtttcacattgaagaactccctttaacatttcttataagacagacatgttgttgatgaaatcctttggtttttatttttctgagaaagtatttctcctttatgtttgaaggataattttgctggatatatataactttctaggttggatgttttctttccttcagcactttgaaaatgtcatctcgctctcctggactgcaagtttcctactgagaagtctgctgccagatatgtcagggattctttataagttgtgtgcctcttttctctgctgcttttggatctgttccttatccttgacctttgagagtctgaatattatataccttgaagtaggtatatactcaaataagtatttgagtatatttgaggtatctgttggtgttttataacctcgtatctggatatttatatctttctacaagtttggaaagttctcagttattatttctttgaataaactttctagctcaatctttatttctacatactaattaaggccagtaactctttaggataacttttcatcttctttataaaccagaggttgtaaattttgatgaattaccacttattattattttaaaaaatgtctgtactttttgtattctatctaaaagacctttgccaagctcaaggtcacatttttctcatgcgttttctaggagatgttttataattttggcttttgtcctcagatatttgtgatccatttgagtgaattttcatatattgtgcgaagtaagggctgagatttttataaaaataggctgcgtccagtggctcacacctataatcccagatgctcaggagcctgaggtagggagactgctggagcccaagagttcaaggctacagtgaactatgattgtgccactgcactacagcctgtcatttagagacaggcaaaaccctgtgcctgaatgaatgaatgaatgaatgaataaatatccaattgttccagctttttccattgaattaccatggtatctgtgtagaaaaatcaattggccatatatgtgtgagccgatttttgtactctattctggtccattgatgtatattatggttattctagtatcacactctattgattactgtagctctctaaatctggcggtgtaagtcttccatctttttttccattttaaaaagttttgagctattctaggtccttcatattgcaatataaaatttagaatcaacttgtcaatttttgaaagaaggctgcaaagattttaattggggttgcattggatctagagaggggaaaattgagtctttaacaatatggagtcttgtaatgcatggacatggtatatcacttctttatttaggtctcttttgtttcagcagtattttatatttttcaatatactggtgttgtacatagtttgctaaattcctaaatatttcatatttttaatattactaaatggtatttaaaaaatttaaatttataacagctgattgctagtctatgtaaaaattcattttcaaatatgggtttggtcatgcaacgttgctaaacacacttattaatatctgtagcccattggtcaacaacttattttctatatagatgctcatgtggtgtggtaataaacattgttttactctttctttttcagtgtgtatgccttttactaattttctttgtcttgtatttttaggatcattagtacactactgagtagaagtagtgacagcagatattcctgccttttcccttattttagcagggaaatatgcagtcttagcaatgtgtttaacatgacttttatcaggttgaggaaatttacttttatttctagtttgtttagtttttttcatgaacagtgttaaatttcctcgaaatagtttttttttccacatcttttgagaaaaacttttgttttttcattttctgattttttaatatggtgaatggtattgattgacttttacatgttaaactgcaattgcattcttggataaagcttacttggtcataatatattatccttttcatatattgctgaatttcatttgctaaaatcttaaagacttctatgtctatattcataagagatattagagtatgtatttttcttgtaatatctttatatggttttgtaatctggctaatgttaaatgatttaaagcatgtttcatcttttttaagagtttatgtagaattgatattatttctgtcttaaatggttgatagaatttgatcagggaaactatctgttccaggactttgtgagaatgattttaattatgtatgtattttctttactagatatagagatatccaggttcaaattgtaacaaatgacagggttttctccctttttaaggtcaaataagattacactgtgtatatacagttgtccctcagtatatatgggggattgattccaggaccccataccaaagccagtgcagtcggcctggggaatccatatgtaggaaaaattggccctctctgtataggaaaagttggctccccctaaacacaagttttgcatcctgcaaatatggtattttctatttgcatttggttgaaagaatctatatataagtgagcccgcacgtaagtggactcataaagttcaaacccatgttattcaagcatcatcaatatgccacatgtttttcatctattcactccattggatggacacttaggttgatgagcccttaggttgattccatatcttggctattgagactaatgttacaatgaacatggaaatgcagatatctttttgacatgctgatttcatattctttagatgtatacccaatagtgaaattgctgggccatacggtagttctacttttaatttttaggaggcttcatattgttttccataatgggcgtacttcttcccaccaacagggtacaaggattcccttttctccacattcttgccaacacttgttatcttttgtctttctgataataacgattctaacagatgtgaaatgatatatcattttggttttaatttgcatttttctgatggtgagtaatgttgaacattttttcatatacctgttgggcatttgtgtatcttcttttgagaaatgtccactcatgtcctttgcccatgttttagtttggttatttgttttcttgctgttaagttctttgagttccttatatattttcatattaaccctttaacagatatatcatttgcaagtgtattttcccatttcataggttatatcttcagtttgttgattatctccttgctatgcagaagcttgtttgatgtaatatcatttgtctacttttgcttttgttacctgtgcttttggcatcatatccaataaatctttacccaatgaatgtcattaacttctcgactatgtttttttctagtagttttaccatttcgtgtcttatctttaagtctttaatccatttttagttgatttttatatatgatgtgaaatgagggtctaattttattcttctgcatgtggatatccagttttcctagaatcattaattgaagagactgtctttttcctgttatgtgtttaggcatcttcatcaaaagttaattgactataaatgtgtgaatttattttcaggtcccctgttctgtttcactggtcttgtgttagtaccatgcctgtacaatgttgttttcattactacagttttgtagtagattttgcaatcaactaatgggaggcctctggatttgttctttttgcttaaggttgccttagctctttggggctttttgtggtttcatactgattttaggatttttaaaaaattttttgtgaaaaatgtcattgagagtgtggtagggattgctctgaatctgtagatcactgtgggaagtatggatattataacaatattaatttttccagtctgtgaatgtgggatctttccatttatttgtgtctttttcaatttatttcatcaatgttttatagttttcattgtacagatctttcacctcattggttacatttatttatttatttcaagtattttcagtttttttaatgagcaataaaagaaaatgtttcggctgggtgcagtggctcctgtaatcccagcactttggaggccaagatgggcggatcacaaggtcaagagatcgagaccttccaggccaacatggtgaaaccccatctctactaaaaatacaaaaattagctggcgtagtggcacgtgcctttagtcccagctacttgggaggctgaggcaggagaatagcttgaacttgggcggtgggggttgcagtgagctgagattgcaccactgcacttcagcctggcgacagagcaagatttcatctaaaaaaaaaaattcaatagttaagcatgactgaaacttgattatatctgctttttataaaaatatcttgatatctgtgtagataatgtagggttgggattaggtacatgaatagcaacggagttgtggagacttcttagcaagctaaagtggtagtaattatgagagattctggaaatttagctacactggcattagtgggaaaatgtaaactagtttgtttgctttttcagtaaactattttcaagaattaacaggactaaaacatgagaaagaaatgtttgaatgcttctattcagaatgcttctattctttctacattaaagcaaagagacatctagaagtcatctctgtagacaggtgaacagttacattacttaatttcctctgaatcagatttgtgcttaattgctgagagggcaccatcagggagggaattcagattaatgtttgcatagggtgtgcagtggaccagagtatatttttctatgttagcaagatgaactaatctagtgattaaaaaaatacccattaaagtaagatacaaagaacaaatacagttcagttttatcacatttatttcatttctgctgaatttagatactaccaacaatttggagttagctgcagatttttaaaaatggattttttttgttacttgtttagttttttttttttaattatactttaagttttagggtacatgtgcacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcattgttcaattcccatctatgagtgagaacatgtagtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcataccctttggccactttttggtgggcttgttttttttttttttttgtaaatttgtttgagttcattgtagattctggatattagccctttgtcagatgagtaggttgtgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccattgctcgtttttctcaggtttgtcaaagatctgatagttgtagatatgcggcgttatttctgagggttctgttctgttccattgatctatatctctgttttggtaccagtaccatgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatggggatggcattgaacctataaattaccttgggcagtatggccattttcacgatattgattcttcccacccatgagcatggaatattcttccatctgtttgtatcctcttttatttcattgagcagtggtttgtagttctccttgaagaggtccttcacatcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagatattgggctgaggcaatggggttttctagatatacaatcatatcatctgcaaacagggacaatttgacttcctcttttcctaattgaataccctttatttgcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttacatgatggattacatttattgatttgcatatattgaaccaaccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcgtaaaggtgtttgtagtattctctgatggtagtttgtatttctgtgggatcgtttattggaataagagaatagcttggtcattgtggaagtatgaaatgattgtattttaatatacagctactttgttattacaaccagaagcagggttcaaaagccctaacaatgatgaatttcttttattatggccatctacaagtataaaagttttcaaaaaagtggtaatactccaccaacaaatgtaaacaagcgaaacttcaaacctagagcagtaatagagattggtgtttgccatataagctgttgaagggaatcttttgaagacatctacaatgacttcttagagaaaaaacagaccctatgtcaggttcacagtaaataatagccccctcatgtcttaactgtctaactgaatgtttatggaaaggcaagctaggaaataagcccatgatctggtcatttcttggtacatgataaagtacaaaatgtactcttcttgagcgtttagtttacttttgagcctcttaggattcttaaaagtttaaaactagattgggccacctttttttttttttttttttttgagatggagtcttgctctgtcacccaggctagagtgtagtggcacgctcttggctcactgcaacctatgcctcctgaagtcaaacgattcttgtgcctcagcctcctgagtagctgggactgcagaagtgcaccaccatgcctggctatttttttttttttttttttttgtatttttagtagagacagggtttcactatgttggctaggctgctcttgaactcctggccccaagtgatcctcctgtcttggcctcccaaaatgctgggattacaggaatgagccaccgcacctggcctagattgggtcaactttaaaatttatcttatggttgaaattactgtatttctaaatttaaaaatatagacataatcaagtaaagaatatatagtcttattggtagattatatcttggagatataatccttgcttatttttgagtattttattttagtttttaatgttgtaaggggatcttttttggtttctttttcagatagtttcattgttagcatataaaaatgctactgatttttgtacgtttattcatatcctgcaagtttacggaatttttaaatttttttttacagatttttggtggagactttagagttttttacatataacatcatgtgatctgcaaacagaggcaacacttctttccaatttggatgtctttcatttttttcttttgcctaattcctctggctagggcttcttgtattatgttgaatagaagtggtgggaatgagcatccttgtcttgttcttaatattagaggaaaagccttcaacttttcaccactgtagtgttggatgtggacttgtcatatatggcttttattatgttgaagtacattcctttgatacctaatttgctgagagtttttatcatgaaaatatgttgaattctatcaaatgctttttctgcatctattgagatgataatagaattattgtccttcattctgttaatgtggtgtatcacattaattgatttttgcatattaacccatcattgcttctttgggatatatcccattttatcacagtgaattattcttttactgtgatcttgatttttatttgctagtgttttgttgaatatttttccttctatatttatcaggaatattggcttttatatagtgtcattgtctggctttggtattagggtaatgctggccttgagaaataattttggatatgttccctcttctattttgtggaaaagtttgaaaaggattgttgttaattcttctttagatatttggcagaattcattagcgaagctcatttgttcctgggctttctttgttgggaggtttttgattaatgattcaaaaacttgattagtgtttcaatcttatagttgtaatgctcttttaagctgataacatcttaacttagatcacataaaataactctacacttttatgccaactctacccctcatattttatgtttttggtgtgacgatttatatattttattgtatattccttagcaaattattgtagctattatttttgacacttttgtctattaacctttatactacagataacagtgattcacacaccaccattacagtattagaatattttgaattgtgtccttacttttactagtgagttttatactttcatacattttagtctctttgatagctgataggactttgcctgttttttttcaatgtggcagatgttgccttctaattgacagttttagacgatttatatttaatgtaattatcaatatgcttggatttaatcatgctgttttgatttttgccctctaattattctattagtttctttttcctcttacgatttcattttttctccattattaacttcttgagtgtaattgttgatatacttaaacttaggtctactattttattattcagttctttgtgtttcctgttttttattcttgtttcctttttcctgtattcatttggattatttgaacattttttagtattccattttaatcttatcttaatgtgatatttactattatctctttgtaatttttaagtgattgctccataaattaaaaagtaatactttttagagtgtactaagaatcaatattttgtcacatggtttggaatgcggaaaccttacctcattacaggtacctttaccttctcctttcatatgctaccatttcttgtatatttcatctacaaacattgaaaatcccataaggccatgtaaatatttttgctttcaaccatcaagcatactttaaagaactcaaaaagagaagaacagtgtattgcatttacccagaaatttaccatatctattgttatttcctcattccaagttgccttctgcttcatatcccttcatctgaagagcctcatctagcatttcttttagagcagctccactgactgtatagattatcttagtttttctgcatcttagaacgtctttatttcacacttatccgtgtaggatatttctgttgcatatagaatcccgagttataattattagcacttaaaaaatgttgggccacttctttctggcctttatggtttcttatgataaaaccatagtcatttaaattgttgttcccttatataatttgttatttttctgtagcagctttcaagatgatttcttcatttttatttttcaacagtttaattgttacatgcttggtgtggatttttttgaaaataccttgtttgtgatttgctcaggttcctgaatctttaggactattattaactacatctttttgttttgttttttcaaatggttgctgtattatttacaatatacatctttagcttatcacattctacctttaattatgttatatcacttcatatatagtgtcagaaccttaaaatagtatacctgattttttaaattgtttctcttgagctaatatcatatctatataggttataaagaacacaataaattgttctagtgtttgtttttaacagtaaattatcattttagagagataaaaatgatagatgatttatatttatccacatattaactttctcctattctctttattcatctgtataaatccaaattctgtataatattctttttttaaattatactttaagttctagggtacatgtgcacaacgtgcaggtttgttacataggtatacatgcgccatgttggtttgctgcacccatcaactcgtcatttacattaggtatttctcctaatgatatcccttctccagcccctcacctgccgacaggtcccagtgtgtgtgatgttccccaccctgtgtccatgtgttctcattgtttaactcccacctatgagtgagaacatgcggtgtttggttttctgtccttacgatagtttgctgagaatgatggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttcatttatgtgcttcattttggacagtttatatttctttataagttcactgttcttctgtaatctctaatcttgtgctaattctgttaaatgtatttttcatttgaggcattcatttataggcattctatttcatttataggcattctattagtttctaaaatttttgctattacttgttatcatattcatgttttctgcaacattattaaacatatttgagtatatttccaatcattttttaaaacattctgttctaccacttctatcttttgttttatttctgggtctctttctattggatgattttctttttgttatgaattatatttcctttgccttctatactttttaattttttcatatgttttaggcatgtatattttaaacttattggctattagattttgttgtattcctttaaggggtgttggactttgtgctgacacacagttaaattgccttttaccagcttgaacattctgggagtttgctccttagtcttgttagagtggatccagagcaactttcagtttattgctcatttattttggtactacatctcttctcaggactctacctaatgcctcctgtagtacgaggccatttttctattgttgcttggagcacaaactgttcccagtgctgtgtaagactcaagaggtgtttactagttttttcttggtcctttccatagccttaagtagttttcccgttttgcacatgcagatcagtactcagctaaagacatgtgggacttttctgcagatctctgtgttttctgtgtgtgcaagctggtttgatttctttcttttttttattattatactttaagttctagggtacgtgatttctttaaactctaaactttgttttctcaagttagtgagatcaccactctattttggatctcactgagtttctgtttaccttacaagtaatcagggtaattcattatgaaatatagtatttcacttaaaatactacggaagcaaaaactactataaaagtaaaaaataaaaatgactcaaatataacaagagttcttcattaggccatgatggagtaatttggaaagcatttcctgccataaacaactcaaaaaccagaaaaaatatatgaaaaatgcttcacagatgttggataacaagcagaagtaaaatatttatttctctttaaagaaagagaaatatttatttcgcactaaaaagtttatttctttctctttacttcctacatcttgtgtcatggccagggtattgcctacaagcagtatgctctggcaatcatagagcctacacttgtttctgtttcttttagagtcatagtcctatgctgtcacaggatcacagtgtaatgctgcttggtatctagtatccataaagcattttttattttgtttttttttttttctggtttctgagttgtttgtggcaggaagtgttttctaaattactccatcatggcctaatgaagaattcttggtatatttgagtaatttttgctatttacttttgcagtattatcctgagttagttcatgtattcatgcatctgttttcaccactgtcttttctcattaatgacctacttttgaaccagtggtttacttttttataaattgagaatatgataaagcacactaccaaattgaaaaaaaattcacgcatatgcaaataacaacagaggataagaacatatgttttctgaggtgatctatatgttgttatcttgcatgtttattgagaccagttggttccttagagcatatatacatttccaaatgcaaaacataagaagaatataatgagaatgtgactcaaattaatcttgcttttcaaatttgtctcctgtgtgggaagacaattgtttccttttaatttttcacctgaaactactataccacttatgaattccttgcctgaactgctagtgactgaacctagagaaacattgaggtagtacaagaatgcacattttggtgttagacctgtgtcttcgctcttacaattccaaagtttttttaaaaaagtttatcaagtagttaagtgaaatactgtatttcataatgaattatgccgattactggtagctgatcactagtagtgaacattatatttttaaaataaactttttattttgagataaatgtagttacaggtatataattgtaagaaataatgaaagtgattctgtataccctttacacagttttctctcatagaaacatcttgcacaaatgtgtaacatcctaagtctagatactgacatggatataatcctatgatcttacttagaaattcccagttttatttgtatttgtttgtgtgtgtgtgtgcctatttcattctgtgcagttttatcacacatgttgatatatctcccaccacagttaagatacagagtagttcttcaccccaaagatccttctcattgcccctttaaccacacatacctcctttctaccctggctcctcacaaccaccagtttgttctccattttataattttgtgattccaagaatgttttatatatggatcatttacatttaaggtaattttgatatattagtgactaagtctgctgttttattatttgttttctgtttttttccttttcttgtgcctctttttctctttacttgcttcctgtgggttatgtgaataatttttaggattcctttttgatgcacttgtatagtgttcttaatagtatctctttgtaaaattttgatagtatcttctgtataattttcttagtggttggtctgtgtgttaaaatatatatatttgacttatcacagtctactggcaccagtaatttaccacctcaggtgagatgtggaaaccttgctttcatttacgtcactttagctttacttttctcacttttaaatatcattatcttgagtatcggatggtgttataatttttttccatcatcatatattatttataaacattcatgagaaggataatctgttgtttgtattcatgtttctgctctatttgttgtcctgacttctttttttttttttttaattatactttaagttttagggtacatgtgcacattgtgcaggttagttacatatgtatacatgtgccatgctggtgcgctgcacccacttttctgatgctccaagcttccttcctttatctttctgtttgaagaagttcttttaaccattatttaaagagagacctgctaatgacaaattctttttttttttttaatttaagaattttttccctcttaattcctgaaggatagtttcactggaggtagaattcatactttacagttctttttctctccagcatttgaaaacagttgtgctacttcttttggacctccatggtttcagatgagaagtccattattattaaaattattgtttttctaggtaatttgtcatttcactctggctgctttcaaggtttttttccttgtctttagtttttagaagtttaattatgaggtgtcttggcatggatatctttgggtttaacctatttaagatttacttagtttcttgaatctgtaagtttatgtcttttacaaaatttggaagtatttggccatcatttcttttttttttattatactttaaattttagagtacatgtgcacaatgtgcaggtttgttacatatgtatacatgtgccatgttggtgtgctgtacccattaactcgtcatttaacattagttatatctcctaatgctatccctcccccctcccctcacccacaacagtccctggtgtgtgatgttccccttcctgtgtctatgtgttctcatcgttcaattcccacctatgagtttaaaaactctgtaagccccatttctttttcttctccttttgggattatggtgctacaaatgttggatcatttgttattgtcctaagggtctctgagactctgttcactgttttctctatttttcatattggataaattttatttatttttatttttaattttttgtttatttttataattttaacttttattttagattcagggggtgaatctcaatgcaggtttgttatgtggctgtattgcatgatgctgaggtttggagtatgattgatcttgtcacacaggtgtactgagctcagtacccaatagttattcaccccttgccccactccctctctcttgataaattttattgttctgtcctcaagtttaacaattctttcctttgtcatttccactccggttttgagcctatcccgttagtttttatttgttattgtagttttttttaaacttttttttttttgctgagatatttttgtttgtttcaagataatttgtaatagtagtgaggttgcagagaaaaaggaatgcttatacactgttggtgggagtgtaagttagttcaaccattgtggaagacactgtggtatttctcaaagacctaaagatggaaataccattcaactcagcaatcccattactaggtatatatccaaagaaatatattaataaattattctattataaagacacatgcacatgtatgttcattgccagcactattcacaatagcaaagaatcaatctaaatgcccatcaatgatagactgaataaagaaaatgtcgtacatatacaccgtggaatattatgcagccacgaaaaagaaagagataatgtcttttgcagggacatggttggagctgcaggccattatccttcacagattaacacaggaacagaaaaccaaatactgcgtgttctcacttataagtgggagctaaatgatgagaacacatggacacatagagggaaaaaatgcacactggggcctattggaggtgaattgtggaaggagggagaggatcaggaaagtaactaatgggtactaggcttaatacttgggtgatgaaataatctatacaacaaacccccgtgacatagatttaccaatgtaacaaacctgcacttgtaccccaaaacttataataaaagttaaaaatagttatagttacatgttggagtatttttatcatggctactttaaaattctttttagataattttaacatctgatccattcatctcagtgttagtattacttgattgtctcttctcattcaagtcgtgatttttcttgttgtcggtatgacagggagtttttgatcatatctttacattttgggtttcatagtgggagtctctgggttctattttaaatcttttatcttagcaggtagtcacctagtttgggttttgcattcaggtcttgtggtgagatctctctttgcagtcttaggccttgtggggaaggggagtgctttccctgcatatttactgtaagtagtatttggcaggtcccttttgctagggctgccagggtcatctggttttgtccattggactcgtgttcagtttggctaaggaataagcctacccaagtaaccttttgttctaaggatgggggttgagaagtgctgggcctcagtaaccttcttctgttgggtgagtgagtgtcatgagacacacattctccagtccctagccagtctgccttcgtctttacactttagattttttctttggttgtctcttacacagtttctaaggtctgtggggggagcagggaaaaatcagtctacactatcttgttccacttattaacttttaaacttttgatgtgttattcaatttttctagctttgaatttcctaatttgtaaagaagagatagcaataatataaccctccaaagattattattaaatgagataatgagatagttactgagaactgtgctctattagagaatgatgctgctgttgattgcaaggttgtttattgcaccattgtttctaagggcaaattgaaacccaaatgagtaacaaagtagagttatttaaataaattgtatattatcaacacaatgaaatttagctcttaaaaaagtaataaatgggacacagaatgatgccccaaatgtcttgttaagtgaaacagtagttgcaacatagtatttttagtacaaatatgtacacacacacacacacacacacacacacacacatatatataaacatatctatctaaaaaacatgtacatgtgttttatgtatacgaaaatattcagaactgtagtttgaaaatagtctgtatgtaacaaattgtgaaatgtacctctaggtagtgggctgggggaaagggtaacttttacattttatacctcttaattcaatattttttggtaaggatcaagtttatctttattaaaaggaaatgaataaaactatgaaaatcttttagttcaaatatatatatatatatatagttaagtggttaaagaatattaatcaaattatttctgataagttgtcttttacttcattttttggaaattacctccaaaatgtaatgcctgttagttacatatgagttccgcaaagtttcttaacatagattaagtaccagtggcttggatgacttttttggatatttctattttttatgatcattgtagaatcattttctttactaccttagaattttgtaaatgcaaagaatttttaagcattatcattttctattagttgatttgggtattttcaatgagctgactaggatgccacattttaggtggctggttagaggaatgatggagatgtgatctatatgcatatttaaaaacaaatgacagatttttatatagctgctttttataataaattttctaaggccaagaaattgtgggcttttcgtatgcatttcttaaaagcatcccttgcatatgattggtgtttttattagtgaaactgcattgggaaatgaatctattgtagatacagcaagcagagtgggattttaatatcggaaattagttacaaaagtgttagaaggactagagataccaaagggaagggatcacccagaaatccagaagtgctacatacctaggctggagcctatgatcacatttgccactgagcaactaaacataccagttttgctactgagcagggaatacctattaagccagcactgccattacttactgtaattgccttcctgttcctgctgctagaggcaaaatcagaatctttcctcttgccctttaatctcatactagtactcccattggtggaacctaatgtaacacaattgtcaagcgagtcttggaaattttattgtttaggttttcatcctctgcaatacaaaggactttataaaaaggaaagtggggcttataaccaacaaataaaggaccagcacagtactaaaaatgtgttcaattaattttagatttctaagggtagggatcatatcattttatctttataatgtcagtgactaactgtcacatagtaggctctcaaaatatttgttaaaaatttttttcagagctatttatgtaatataagaataaagttttcctttttctcttgcaaacacataaaatgttctttttagtatttcagagtttaacttcatctatggaaagaccagtgttactcaacttcaaacccagcacctaacctggcacatacttaataagtgtttcttgattaaattaatattagatatacaatgtttactcataaaaatatgtcattagaattaacttgttggtattttggtgatatattagttatatttaaaaatactacttgaaatttataatgtattttatttctgttacagcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttggtgagtacacaaaataacacattttctatgttgccattattattgtaaatgattgactttaaaatggtttctgacatagaaatacttactttatatgcattcattgtaaatgctgatatcgtcttaatttcagatgagtaattttgtttaccagtatgacttcgatatcatctgttcagggatttgttcttctttgcactcatattttattgtcatctgtaaattttaaaaagcatttatttagtttcatcatctaacttcctgtgaaatacagagcttgtggcatttaggtaaattttcaccttttgttgttataaacaatgctacactgcacttcttgcactgatcttttcatgtacatatttaagagttgctctagggtgcatacttaaaagtgagatttttgtatctgagagtatttatatcctcaactttattacatgttgccgaagtgcttttcaagtcactgtggtaatgtgtatatacttccaccaacagggtatgtgtccctgatccttcatgttctcaccaacacttgaaaattgtgagaatttttacttttgccaaggtgatgggtgtgaatagtattttaatgtgcattttcctgattagtattgtaaacatcttcttatgtgttgatttcctattgtttcctgtttagtgaattgcctactcatatccataatattctctttatgtttgaaatattattaattaatttttcatttattggtttttttggttatagaagttttaaaataaaatttttgttctaatttttctttgtaaaatctgggaaatgacttttttttcttttaagacagtatacattcttttaaacttctagcattaagttactttatgtgatcaaaggaaatacacaggtttccatcaaatcatgatttgttctaccctcttcactttcatacatatatcctaatttctactttttaaaaaaatatagaattataacaccttttttcttttggtaattttgataattcttatttttagtctaataaaatgtagttttattctttatatttttatattcatttttattttgtataactcataaatagcatcttctgtacatttaatatttgtaaatttttctctgacattttgctatgttagcaagtggaattgtggtatagtgatgaaggtactatcagtctgttacacattttaaacatgtatttaatttaatttaatttatttatttgagacggagttttactcttattgcccaggctggagtgcagtggcacgatctcagctcactgccacctccacctcccacgttcaagcgattctcctgcctcagcatcctgagtagctgggattacatgcacacaccaccatgcccggctaattttttatttttagtacagatggggtttcactatgttggtaagcctggtcttgaactcctgacctcaggtgatccacccaccttgacctcccaaagtgctgggattataggtgtgagcaactgtgcctggccctaaaaatattttttcaatgctgtgtcataccaaaagggaagaataacttctgtatgaaggaggcagtatagttcacagtaataataatgggtatagcaatgctcaggtaagaagaatcttaatgaaagtgaatggataagagagcagaattggatattatttgtgtaaagtcaaaatgagagattcagttgttgctcactacttgaataaaattttgttaaattttccatgattttctacctgaaaactttacatagtgaaagttttgcctagatgaatattattgtcagccctggcaattttagtatgtgcacaaatggcactggatatttatatgtaaaacaatttactaaaataatttgtaaattattttaaacacctcattacaaatatgttgtagatgtatgatgctttaatattttaatgggtcttaaatttctttaaacacacaaagttatcagtgagcactaattgattttttcattatccttaaaatttgtagtattctttaagcttagatcttttttagcatatttgtcaagtttgctattatatatggattatgtcagtggtccccaacctttttggcaccagggactggttttgtggagacagtttttccatggacccagggaggggagatggttttggaatgattgaagtgcattatatttattgtgcactttatttctattatttttattacattataatatataatgaaacaattatacaactcaccataatgtagaataagtgagaatcctgggcttgttttcctgcaactagatggtcccattctgggggtgatgggagacagtgacaccgaaagtgttttgcctatgttcagtctactccataatctcattttggttgctgtcactgcagaaaactctgctccacgaagacaggatgctggaaatagaagcaggctttttggtgcttttgtggcaatctcaggatattctgccttgactttaactcacaatgtatagtgatttgaagttgtcttaaacatacttttaaggctactgtcatttgcgatctcatgcagttgatcctcttctagcatggacaaagtcgattcacctggcttactcgcaaatgggtcgcgtatccattccttcccagtttggggtctttttgaagttgggaagtaatgctgaaattcttttgtaagctgtaatagttgttcatgcaccagctgggagaaagatggtgctgggagaaaaaaatctcttctaatgtttgaaacatgtcagaaattcgagagtttacttgtcgcccccataattccagtttggcattgaatgcagccactttacctgccaacttgaatgcagttgttattctctcctgaagtgacagaatgagtttcttgagcaggttgaatatgtcacacaagtaagcaagttttgcaacccattctgtgtcactgaaatgtgctgccagtggtgactgtttttctaaaagaaatctctgcagtagcccttgtaagttgaaaactctgaccagtgacccacctttagaaagccacctcacttctgtgtataagagaagacatgcggccgggtacagtggctcacgcctgtaatcccaacattttgggaggccaaggtgggcagatcacgaggtcaggagttcgagaccagcctggccaatatggtgaaaccccatctctactaaaaatacaaaaattagctgggcatggtgatgtgcgcctgtagtcccaggtactcgggaggctgaggcagaagtgcttgaacccaggaggcggaggttgcagtgagctgagatcgcgccactgcactccagtctgggtgacagagtgagactccatctcaaaaaaaaaaaaaaaaaagaaaaagggatgacgtgtgtgctttgcacccatctcctcacagagctgtgtgaacagatgtgagttgagggcatgtactttaatgtggttgataattttcatcacatcttgctaaatattgttaagttcaggtgacatttttcgcctagccagcatttctctattgatgacacagtgagtagactcacattcagaagcaacctctttgacccaagcagtaaaaccagaaagctgcctagtcatggcagatactccatttgtgcgtatattgacaaaaaatgaccaattcagttttcctgatatgtaatcattcaaagatttgaatacttctgcagctgttgtgttggttgtcaacaaaagttcacataatagtctgggcatggtggctcatgcctgtgatgccagcactttgtgaggcagaggcaggtggattgcttgaacttaggagtttgagacaagcctggctaacatggtgaaaccccatctctactaaaaatacaaaagttagccaggcatgatggcacacacctgtagtcccagctacttgttggtctgaggtggaaggattgcttgaacctgggaagtggaggctgtggtgagccgagatcgtgccactgtcctccaggctgggtgacagattgagaccctgtctcaaaaaaacaaaaaagagagagagagagaaatgtgcacataacatatcctcgtgcacagcctcctgaaaaatatattgcacaaaaacaaacgttttattgtcaacatcagttgactcatcaacctggattgcttaccaaggtgacttattaattctctctaacaattgtgcctcagtatcctctgctatttcatcaattcctctagttatggtgctagctgaaagaggaacacatgtcaccttttgaactgcagtctctcctaaaagactacaaatgtcttcagcaataggcaggatcaactcttcatcaatagtaaagggcttctatggtttagcaatgctgttagctactaagaatgatgctcttagtacagacccatttgatgaagtggtggctttcaataattgcttcggctcttcgtgttcactttttttcttttgaaaaactccaaaggcttgttttttaatgcagggtgcttggtctccttgtggtgaagcagttttgaaggtttcatggtttcattggatggctggttgcaacgtattgtacaaagtggacttggagaatgtgaatcacctgttgtaatgaacccgtaatttaagtaagactcttagtattttctttgaaatgcagctttctttttgttggcagtctaagagtcttctgctatctcatcattcccccttttcaaagaagctctccagtgatgtttgttttttactcagtttggctaaggtttgtttgtgggcttaccaaaactgtaactgaaacaagtgtgcagtgtgggaaagaggtgtggacagaaatggtaaataaaataatggggggggggggcggggtcaggcagtgcccgcatggactaaaataagtattagattctgccttcaagcttgctaccagatgcgactgtaaaattgaagtacatcatctcacttgccactataaagcctgctaccagatgcagcttaattatcacttgccactcactcactgatagggttttgatatgagtctgcaagcaattgatttattgtggtccctgtgcactcaaacctctctgctaacattaatctgtatttgcagccactcccaagccctatcatcatcacctcagctccacctcagatcatcaagcattagattctcatagggacatgcaacctagatccctaacatgtgcagtttacaatagggtttgcactcctatgataatctaatgttgccactcatctgacaggaggtggagctcaggcagtaatgcgagtgatggagaatggctgtaaagacagatgaagctgtgtttcctcacttgctactcacctcctgctctgctgcctggttcctaacagggtgttgagaaccctgggattatattgtataggatgtcaccattatgtgtccattatgtatcagtattatgtatccactgtatagactgatatttattttttaccacctcagaactggtttcggtttttagtagatatggttacatagatagggcactttgttgagatactaggaaatgtgttttgaggacttattctttttcagtggtgaaatgaattcttttggactgttacttcccctgagaaaaattaggaattttatttgcctaaagcatgagagaactatcaaaaccatgagaatttgtcagagatttaggagaggtacaatgtcaagggatacaagacaggcattttgtgtaattttaaccttgagacagttagaaatcctggaaacctcctgagacactgagcagtccttttgtcagccattacagaggaacaaaattagatatccagatgtgccaaggaagaggagccttggtacatacttaaggatttagtctggcccctgagattctaaaccctactcgtgataattagcccacctttgaatcatcataatcttttattagattatggtgaaatgcccataatgtagttagatggcaacataaaaagtaaatactttattgagtgagataacatcatatggaggcttaaagtatttcttctatatatcatatacaatatctggcacaaactaaaaaaaaagctcggaagaagataagatacgaaaaaacaacatccgttagaaacatacatataggataatggagtgttttagacacaaactttaaaataattattgttatgttcaaggaattaaaatttaaggtagagaatattaggacaggcctggatactcatacttatgaatcaaatggaaattctagaactgaaaaatacattgagtaaattaagaattccttggatggaaataacagcagattagacacagctgaagggggaaatatgaaatggaagagagatcagaaggaaacatccagaaggaagtaaagaaagacaaaatgatgaccaaaaaaggacagaaagaaatacaaggaagatgtggaaattgtctaacccacatgtgtaattggaatcctaaaaagagaagagtgaagacaaatgtgtaacattattttaagtgataatgaataagaaattttcaaaagtgacaaagacatcaagccacagattaaagaagttctgtgagcaccaaggggcataagtacaaagaaactcagaaatattatagtaaaactgctgaaaaccaaaacatgaagacaaaaatttcaaagcagatagaggaaaaagggcatatttcctttaaaggaaaagcatgaagacaattaattttttaactgaggaaatgggatccagaatacatgttttcaaatagcttaaagacaataatcatccatctaaaattctacataattaaatattcttaaaaatgtaagcaaaataagagcatttttagaaaaacaatgactgagataacttgacagtagtaggctttcgataaaggaaatactaattacaataagtgctattgaagtagaagaaaaatgatcccagatactggatggaatgtaatgaaattatagagatgattctaaatgactatcatataaagctatagtaataatagtggcttgcatatacacaaaatttaaatgcatggtcctaatagcacataagtcagaaaaggggtaaattagtgttaaaaagtctgaaagttggtcgggcatggtggcttatgcctgtaatcctagcactttggagagctgaggtgggcagatcacttgaagccaggggttcaataccagcctggccaacatgctgaaaccccatctccactaaaaatacaaaaaattagccaggcatggtggcatgtgcttgtagtcccagctacttgggaggctgaggcacgagaatcacttgtacccgggaggcagaggttgcaatgagctgagatcgcatcgctggactccagcctggacgacagagactctgtctcaaaagacaaaaagaaattccagttatactaaatgtgacagattaaatattccagttaaaagccaagaatttttggattggatataaaaacaaaacttagccatctgctgcttagaaaagataaaccttaaataaaaatatttagaaaagttgaaagtaaaaggaaggcataacagttcttaatttatatataatttataacagtgttgaaataatgtaaaattgaccaaacacaagagacaaaacatagtgagatgtttttaacccaattttcttggtaactggtagtaccaggagaccaaaaaaccggcaagaacataaaacatttgaataggacaatgaacaattttgtctcacttgatatttgagagcataataccttataattgaagcatatacatggtttccaagaacaaaggaactttcccggaatttactatattctgggttttaatgcaagtcttaacaaatttaaaaggattaaaataatacaaattaattgaccacagtgaaataaaaagtaactttttggtgattacataaaaataataagaaaaaccctaatatatatgtgtatatatatttatatataacatatgtgtatttaatatatgtgtgtgtgtgtgtgtgtgtgtgtgtgtgtatatatatatatatatatatatatattttttttttttttttttttttctttgagacagactctcactccgtcacccagcctggagtgcagtgacacaatctcagctcactgcaacctctgcctctcaggttcaagcaattttcctgcctcagcctcctgagtagctgggactacaggcatgtgccaccacgcctggcaatttttttgtatttttagtacagatggggtttcaccctgttagccagggtggtctcaatctcttgacctcgtgatctgcccaccttggcctcccaaagtgctgggattacaggtgtgagccaccgcgcctggccaaaaaaccctagtataattttcatactgaaaattttcatacttaaaattactgaatgatgacacatcaaaatgcatgtgattcagctaaggaggggcacttatagatctaaatgcatttattagaaatgattttctaaaagtctgaaaatcagtagtctaagaatccccttgagaagttagaaaaagaacagcagactgatcccaagaaaggataaagaaaataaagatataataaaggaaaggaacatgagataagagcatgaattaatgaaataggaaacatgtgatagaaatgatccataaagccaccaaaactcgacaaagttggttgtttttaatagtaatagataaatccccacacagacttagaaacaaagattacttaaataatccatgccaagaatgaaaagggatatcatgacagatcacatagagattaaaagttagtaagaacatatgataagcgactctatgaccgtaaatttgaaaaagtagatgaattatgacaaatttctagaaaaacaaaacttaccagaattgacacatacatgaacattgaaataatcttatgtcaaataactagaatttttaattgaaaccttgttgcctcaaaatacagaagcatacatacagatgaacaaataaaaacaaaacaaaacaaattctccaggccgtgatcactttactggtgaattttcccaaatatttaagaaataagcatttaagaaataaataacatcaatctttcacaaactttctggaaacagaaataattatgttgagatttatgaggccagcataaccttgatataaaaatatgaaaaggatgttacaggtaaggaaaattttagtattgtcttttccatggacgattccagcaatttagaaagaaaataatagattatttgggttcattcaaagaatataatgttacttaaaatttataaaatttgaataattaagaaaatagagaagtaatggtctataatcttgaaagatgcagaaaaaattatagataaaatttatcatgtatttatgataaaacctctggtgaactaggaatggaagcaaatcatttatgtggtaaaatgtacaaggacacatgaaaactttactgcaagcattatggtgaaatagagaaagctttccctctaagattgggaatgggataagggtgctcgctgtcaccacttttattcaacattgtattggaatttccagccagtgtaataaggcagattaatataatataatataatataatataatataatataatataatataatatgtatatgggtaatcagttgctgcaaataacatcaatataaaaaattaatccagagtaattctgtataccaggaacagtttaaaactgataatttaaaaataatataatttatgtcactgtcagaacattaataacctaaggaataaatctaatgacttatgtgcaggatctttacacagaaaactataaaaccttattgtgagaaattaaataaaatttaaatatatctcagaccaaattatgacaattgtttgaaaaactcaatattatgcagatgtctattctgcccaaattgatctgtagatttaatgtgatcccaaacaaaattttagcaggtgtttttcttttggaaattgacatggtgattctaaaatttatacaaaaatgtgaagggtaatttttgtataaattttagagtctccgtgtcaatttccaaaagaaaaactttagaagaacaaagctggaggacttttctatccaaattttagaagaacaaagctggaggagttctctatcagatctcatcacttatgattttacaataattaagtgttgttgcaaagacagggaaatagactaatgcagcaaatagaattccacagacagacctatatatttatgggcacttaatctatgacaaaggtggaactacagagcagtctttcttaataaattgttctgggccaattgggtgtacaattggaaaaaatgaatattaagccctacctcacatcatcataaacaaagatctgtttcagatcaatgttagatctaaatgtggaagtacaataatattctagaagataacagaggcaaatatcttcatatttatgagtaaagaaagatttcttaaatggaatttgagtagttttattagtaaaagaaaaatgatagactgaactatatttatatgtctaaaaagtcagtaagaacacaaacatgccatgctcatggatcagaagaatcaatattgtaaaaatggctatactggccaaagcaatttacagaatcagtgctattcctatcagactaccaatgtcattcttcccagaattagaaaaaaaaaactatcctaaaattaatatataaccaaaaaagagcccgaataaccaaagcaatcctgaacaaaaagaacaaagctggaggtatcacactacctgacttcaaactgtactataaagctacagtaaccaaaacagcatgatacaggtagaaaaatggacatgtaaaccaattgaactaaatagaaaacttgaacataacgccacacacttacaatcatctgatctttgacaaggctgacaaaagcaagcaatgaggaaaggactccctattcaataaatgatgctggataactggctagccatatgccaaagattgaagctggacccctacctttcaacatatacaaaatcaactcaaaatggatcaaagattgaaatgtaaaacctcaaacaatacaaatcctaacagacaaccaaggaaataactcttcttgacattggccttgataatttttggctaagtccccaaaagtaattgcaacaaaaacaaaaattgacaagtaggacctaatcaaactacagagctcttcacagcaaaagaaaccattagcagagcaaacagacagcctacaaaatgggagaagatattctcaaactgtgcatctgacagaggcctaatatccggaatctgtagagaacttaagtccacaggcaaaagacaaataaccccattaaaaaatgggcaaaggacatgaacagacacttctcaaaagaagatatacaagtgcccaacaaacatgcaaaaatggtcaacatcactaatcattagagaaatgcaaatgaggtatcacaccagtcagaatggctatttttaaaaagtaaaacaacaacaacaacaacacagcagattcttatgagactgcagagaaaagtgaatgcttagacattgttgatgggaatgaatgtaaattatttcagccactgtggaaaatagtttggagatttcttaaagaactgagctaccatttgacccagcaatcccattactgggtatatgcacaaagggaaataaataaatcattctaccaaagagacataggcacttgtttgttcattgctgtgctattcacagtagcaaagacatggaatcaatccaggtgcccatcaatggtagattagattaagaaaatgtggtacatacataccacggaatgttatgcagtcataaagaagagtgaaatcttgtcttttgcagcaacatggatgcagttggaggccataatcctaagagaaattaatgcaggaacagaaaataaaataaatcagacataaaagaaaacagtatattcttctattgatataaagttcagcaccaggaaaaacagaattatgggcttagaagttatgatagggattgcctatgattgtgtagtatttgaatgagtagcagcaaagcttctggagtggttatgtgttcactttgtgataattcattgaactatacacttaagatttttatacttttggcatatatattatacttcataaaaatttataaaaaaatagaaatctgagttcaatttgacttcttatatgctaaaagattatgataatttgacataccaaaagagggtcaattttttatgtaaagttagcaaattacgtttttattatcagtgttagaaaagaatggagacataaaatttcagtcatttctgctatcccactccttcaggagtagttgcatctggtttcgttacatttaataagtaagagagaataaacatcttgaacttataggagttcctgttgctcaaaaatgattccttttatgtttttggtatattttgctgattcatattatctttgctcaggcactttaactttggtgtaatgattttgaatattggggtcattgtgatcttcattttatagccttgttaaatgaggcatctcataactttctttgcatatgtttgtacaacttataatgggagcttatgtcttcattatttttctatgtgaagacttttctctgatagtggagacctcagattttcttggcctattgtttaggtcttttcttcaattgttgtattcctttagcctgtgaaaaagcacagtaagttttaacacataaggaatttattaaactttaccatttataactttcagctgtaattatcaactttttatttttatttttatttttttccagtgagggaaaaaagacttcaattatatttctttctttcttttttttttttttttgagatgaagtttcgctcttgtttcccaggctagagtgcagtggcacaatctcggctcactgcaacctctgcctcccaggttcaagtgattctcttgccttggcctcctgagtagctgggattacaggcacctgacaccacgccaggctatgtttttgtatttttagtatagatggggtttcaccatgttggccaggctggtctcgaactcctggcctcaagtgatccacccacctcgacctcctgtagtgctgagattacaggcatgagccaccatgcttgcccaacttcaattatatttctacagatattaaaaagataggtagtgaatctaatggtaatgcttctgtggtacaaattaattctgtacttttaaaatgtctttctaatcacatatacttaaaaaatgttttcataggccacacctggttacatgaaatgatttaatctagcttcaatttgatataatagaagttgtttttacattaaaatattaaaaactatgttatgaaattatttttttttgtgatttctctaaaaaatttcctgtccgaggttttggaaagcgatagaggttaattttataaattatgttattatttaaaacccatttcagtaaatactgatgaacatcagcatttttctttctctgcttactgagtgtctgaaatcttttcaatgaaaattttgttggctctttatcaagtcctgttttggaaataatcctaagtagttctcagtaagggagattgagaatttaaaatttaattttatatatttatgagggaaataatagaaatatatacgcacacaagcacacaaacatatagttgcgaagtaagatatcagagatttattaaaatgaaaataaaatgtttatacaggcaaaaagactattatctttaaaaacatcatgataagagatttggaattttggaatgtctggttaaaatcccatattgataatttaaataagtacttatctctgtagctttgcttttcacagtgattaaaaaatttgtagtacttattttttactagttctcttttataaattgggaaatatcacatatggacaaaagactgtatgatagtatgtatatatagtttcaaaaccataataaaatgaattccctgcctacctgtgctaagaaagaggacattacaataccctagaagcccccatgtgtccctttatgattgtatcccttatattatccccctccattattcttaatattgtgttatttccttgcttttcattgcatgtttttaccctccatatatgtatttgccagcaaacctttcatttagtttttctgtttttaaattttgcataaattgtttatcattgtatgctttcttcagagatctttaaaaagtcagctttatgctctggagatatattttaatggagagaggcagacaataaatatggaaataagtaaaatgtattttaaatgataataagtgctatgaagagaaaagaaagcatggaaggaagatagagagtttcagattgttgcatttaaaaagagtggccagagaagacctcataagacatcttaataaaacctaaaggcgattaaggagcgagccatgcaaatatctgggggacaggtgttctaggaggaggtccagctagtgcaaaagccttgagatgggaacatccttgtcatctggaacagcaaaggggctagtgtagtcgaatgtcttggagtaagatggaaattatcttcccttagagaaataactggaaacccagtcatgtagggccttagaaaacattatagagcttttactttggtatgggtagactttgagggttttgaacagatatgtgacttatctgacatatgtgacatgctctgacttagatttttacaggagcggtgttgtaattacgatgcaagagcagaagcaggaagaccatttaggaggctattttaatgatctaagagggagatgatggtatctggaaccatagaggccaatgtgaaggtagtgagaattggttggattccgaatatattttcaaggtagaaccaacaagaattgaaaaaactaggggactggatatagagtggatgagagagagagagagagagagagagagagagagagagagagagagagagagagagaaatagtgaaagatgaagcaggcatttggcttgaagacctgaaagcatggagttggcattagttgggatgatgaattttgtgggagaagtaggtttggtgtcaggaagaatggaaacttggttttagacacgtttaatttgaggtacatactatacagcttgtggatatgttaaataggtggctggatgtaggaatttcaggatctggacactctaattttctggtcaaagagatgaggagaaacaaccagaaaaggagactgagaatgagcagttaatgagttaggaggaaaactgggagaatatggtattctagaagccaagagcatatttcaaaggaaagagaatttgtcagaagctgctgattggtaaactaatatgaggattgagtaatggtcatggaatctggcaaaccagtgctttttgctgaacttgacaagagaagtttcagtgggtggtgaagtcttgattggcatgtgtcaaataaagatgagagaagaggaattaaagaaaagtactaacaacttttttgaggagttataaggaaaggaaagaaacagggtaacaagtggtaagggatgtgggacaagatatatatatttttaagtttggagaaataattatgtttgtaggttgacaggaaagatcaagaagatgtaagaaatgatgccaaaaataaagggaataatttgctagagggatgtactcaagaaaacaagtagcaatgggatctagtgaacaaatagagtggtaaaccttacctaggaagagcatgggcactttattcataagaacagatatgaagtcaggttatttgaatacaaatacaggtaaataagtagaggtggagagaactcttgaaaattttgtttctttttattttctcagtgaagtaggaagtagagtcatcacttgagggtgagaatgagggatagtggaagattgaggtttgaaaagagaagtatgaaatcatttaggagggagggagagtgaatgagttagggaagtgtagtaggatccttggcagaattttcccatgtgagagacccttaatgtgcgaacgcagagtctttttatattttctgccttactgtggatgcatactggaattgtccttagtttttactattatgagcaattgtagcaaaaatattcttatttagtcttctattgtttcacgacagtttgtctaagctatttacttaatagtataaatgcttgttcatgctctattttacccaactatactccagcctcatcttactaatttgcacttctaccaggggtgaatgacagttcccatttcttctcaacaatctcattaaggtttgatgttttttcatttttgaatattttttgccaatatggtgagtataaaatggtgtcctattttggttttaatttgcgtttccttaattgctaatgaggtataacatcttttcatatttattggccaaacagctactctgaaattttcacccatattgtcatatgtagttgtttgtgtacccttttttgataataattttttgttagttttatattttgccaacattttatctctcagattgtggatcatctttttactctttgtgtaatatttgataagcaaaacttattaattttaatatagcagaagttgtcagtattttatggattttgctttgtgtcttgcttaaataatacttacttaccttagtgttttcaatattgccttccacacatttagtctttaacccaactggataaggacttttgtgtgtgtgtgtgtgtgtatgtgtgtgtgcacaaccagaactataaatagtgctcccagaactatttattgaaaagtccattccattagtggtctgcaatactaacagtttttttggttagaattacttccaggtgattgatattttatatgcttttctaggtgaaatctgtattcatttcctatggctactataataaactatcatagacttggaggcttaaaacaacagaaatttagcttctcacagttctggtggctaaaagtctgaaatccaggtgtcagcagggccattccctcttgaaaggctccagggaagaatccttctagccttttccatcatttggcagctccagacattcctgggcatactttgattgtagctgcattactccagtctaactcttggacttcatatggacttctccttgtgtgtttgtatgtgtctgaacgtggccttcttgtaaggacaccagtcactggatttaggacccatacttgtttaggattagatctatgtgatctcattttaacttaactatctgcaaagaccctattttcaaactaaggtcacactccaaggttccaggtgaacaattttgggaggacagtattcattcaaccagtacaatatcttttaatttctttttctgtttatgatctgatagactgaaaggcaattgattttttattactcttatgtctaacagtttgctgtatttttgtaatttatgtgtagacttttttagcgttttttaaataatagttgatcagattatatacaaataatgacagttttgtttcttcctttctgggtcttacagctttatatttttctcgtcttacaatttctgctataatcttcagctcattgttgaatagaagtgtgataacaggcatctattttattcctgagcttttaaaaaatgctttcagtatttcttcactaagaatgatgttcattgtgggttttttagatatcattataaagaaaggtctcttttttcctggtttgataagggtttatattatgaatggatgcttggttttgccaaaggctgttttaggaatgacttacttgatttttctactaaataatttaatgtggaatattattttaatttactttattattaactcaacttgggttaaatcaaacttagtcataatgtattatgtgttttttttagtttgctagtatttttgtaaggatttttacattgatgttaatatgtgagatttgcacatgttttttttgagatattcatgtcagctctttggtggtgttacttcgggcttttaaaatgagttggggagtattctttttaatactctagaacatttatcacatgtatatatgtatatattattggaattatttttcctattttaaaataataaactttgggccaactaggtctgatgttttcttcagggtgtagagttttaactactgaattcaatataatagttgtaagaacattcagatgttctatttgttgttgagtctgttttggtaagatatatttaaaggaatttatccatgaaactgatatcttcagttaaattgttataaagatgttaatatattctctcaggatcttttagtatctgcaatatctgtagttgtgttcccttttaattatttttaatactgcatttatttatatctccctatatatctatgtattgtttttgaatggagttgcttacatgatgccctcttaagcataaatattttaaaatatatttactaaaaagcaaagatactctcttacataaggatcaaatttagaaaataacatggatagaatattataatctaacacatttaattttttcaattgtaccaatattttttacaaattataacattaaaattgctagattcgatttttttctttttcttttttttttttttttgagacagggtctcactctgttgcccatgcttgagagcagtggtacgatctcggctcactgcaacctccacttcccaggttcaagcgatcctctcactttagactcccgagtcactgggaccccagatgggtgccagcagggccgactaatttttgtatttattagggactgggttttgctatgttgccctggctggtctcgaactcctgaggtcaagccatccgcccgccttggcctcccaaagtgctgggattactggtatgagccggatttgatttcttaataagttttcatgaatgttcacatatgtgattggcctgtggttttccctttttatactctccttctcagattttgatacttttttccttactgagtttgggtatcttttcctgatccaggattacatccaggagcatgcaaacatttagttgtcatgtctttttagtctcctttaatttggaatagtcatgatctttcatttgaagtctgtgcctcgtttgggtttatctgatgtttctgcatgattagattcacattttgtatttttgttaggaataccaaaatgtcatattcttctcccatggctggtgaagttaaatttttgtgaaaaaaccttttttattgagataaaagtcataacataaacttcttaattttgatcatttaaaacagtacaatttagtggttttcagtatattcataatattgtgcaactattaccactagttccagaatatttccatcagccccaaaagaaaccccatacctgtctattctctctatctccatcttctggcaaccactaatttaatttctctctctctatggatttgtctaatctggatattttgtatgtatggaattgtacaaacatggcctcctgtgtgtggcttctttcacttattgtgattttttttttccagagttcgtctgtattataccatatatcagtgcttcattgtttttgttatgactgaataatattccattatctcaatataccatattttaaaaatctatttgtcaattaatagacatttgggttgttttcacttttgactattaagaatgaggctgctgtgaacatttctggaaaggttaacttttatatcttggtaaaagtggtatattttagttttctcaatggtaaatatactgtttttcctttttaaattactaagtgccttattgggagatactttcagattatgtaaatattttatttcttattaaacctttacataatagttttaatacccattgatgattctcactagaaagagttattagtatgatggttactaagtggttatatttcattattccttcttagtctccccagtctatatattcatttatatcagtatgaattcatgtatttttattttatttaatgttttgtaatcaattgctattctttattctggtgcttatattgtcacagatttgcctagtgagctcctttcaatcaggtgtctgtattctttagatatgtccccatcattctttgtgcactcctttaccttctgcacaaacatttgtccctgccctagtgctcgaataaatcattaccctcaaggaacctaggttccttttagtggagaatgttctttaaaaactaagattagagaactacgcatatatccatttatatcctctatatccatttatagatctgggcatgtatctgtagctctacatatctatctgtgcttaaatgctgtctgtctaaattgcataatgatgccatacagcattacagggatcatttttgccttcccctctttcacatttgtaaatctcttctgccagtgagaaacttggtttccattttatgcttcatacattacaaaatatttttgtatgtgaagtatgaggaacaagatttactttttccatttaatataccatatctggtaaatcagatgtaattttaatccccacattttttgtttgtttgttttgtttttttaacaataaactctatgttttagagcagttttagttttatggagaaatgagcagaaagtacagaatgtttccaaatactctcatctcccctatccccaggtcctctattatgtgtcttacgtgaatatggtacatttgttacagtcagtgggtcaatgttgatacattactcattaactaagtccatagtttatattaggttcacttttgtgctgtatattctatggattttcacaaatgtatagtgacatgtatctacaatgatcatttcatacagaatattttaattttcctaaaaataacctgtgatcctcttgcttatctcttcctccctccaaactcttggcaaccactgatatttttactgtctccatacttttgccttttctagaatgtcataaagctggaatcatgtagtatgtagccttttaattttggcttctttcacttagcaataagcatttaaagttcctttatgtctcttcatgacataatagcccatgtcttttattgctgaattatgttgcattgtatggaaaccatcttttgtttatccagttacctattgaagaacatcttggttgcctccaaattttgacaattatgaataaagctgctataaacatctgtgtgcagatttttgtgtggacatattttcaactcattcaggtgaccaccatggagtgcaattcctggatggtatggtaaagttatgtttagttttgtgagaaactgccaaagtggctggctgtatcatttttcattcccagcagcgatgaatgagagttcctgttgctctagatcgttgccatcttttgtcagcattttagattttagctattctaatatgtgtgtagtggtatttcactgttattttaatctgcatttccctgtgacatgtaatgtgggatatcttttaacatgcttacttgacatctatatgtcttctttggaaaggtgtctgttcagatcttttgccttttttaaaattgagcttgttttttattgagttttaagggatccttgtataatttggataccagtcctttattagctatgtgttacaaatatgttctcccagactgtggcttgttgtttcattctcataacaatgtctttcactgaggagaggtttttaattttaatagagtccaaattatgacttttttctttcatcatttatgcttttgttgctgtatctaaaatgtcatcaccaaacccaggttacctagattttctcctgcgttatcttctgggagttttatattaaataattttgcattttacatttagctctgcgatctattctgagttaatttttgtaaaagatgtaaggtctgtatctagatgattatttctgttattactactgtgatgccctgttgttccagcaatatttgtccaatagacagtcctttcattgttgaatcgttttttctattttgtcaaagatcagttgaccatatttgtatgtgtctatttctgagctctctattctgtttccttgatttatttgtctattcttttgccagtcccagggactgacttgattattgtagctttatagtaagtcccaaagccaggtgatgtcaatctttgactttgttcttcttcttcaatattgtgctggctattttaggtcttttgcctttacatataaattttagaatcagtttgataaaaatttggtaaatttattactaaaaatcttgctggaattttgatttgtattacactgaatctgcatatcaagctgggaagaactggcatattgccagtattagttttcctatctgtgttcatgtactatctctttatttatttagatttttggtttcttttattgtttgtagttttcctcataccagtcttgtacatattttgttaggtttctacctaagtatttctcttcttttggttctaatgtaaatggtattgtgtttttgttcttgttcactgctggtatataaaaaatcaattgtatattacccttgtgtcctgcaaccttgctatgctagcttattagttctagagggtttttttggttgttgttgttgttgttgttgattctttgggatttacttcgtagacagtcatatcatttgtgaaaaaataccattttatttcttccttcccaatctgtatatcttttatttcattctcttgtcttattgcagtagcaagaacttccactaaaatgttgaatagaaatggtgagatgaaacatccttgccttattccttttcttggaaggaaaacattgtttctcaccattaaatatgatgtttttatagatgtttatcaagctgaggtattttccctctattcctagtttgctgagtttttatcatgactgaatgttggattttgtcaatgctttttctccatctattgatatgatcatatgattttctttgttagcttatcgacatgatggattgaatcaattgactttgaatgttgaaccagcctagcatacttggaataagttccaccttcttcttcattatatttaaattatcttagcttaaatattgctctactagagaatattttgttccttgatccatattatttatttactgtccactagattatagtattttcttgttttgtaaagaaaaattagagactagagattattttattttattttattttattttttgtgatggagtctcactctgttacctgggctagagtgcagtggtgcgatctcagctcgctggaacctctgcctcccgggttcaagcgattctcctgccttagcctcccgagtagctgggactacaggcgcaggctaccacgcccagctaattttttgtatttttagtagagatggggtttcaccatgttggcaagcctagtctggaactcctgacatcgtgattcgcccacttcggcctcccaaagtgctgggattacaggcatgagcaccgcgcccggccggggctgtattttttcttagcctgcctctcctcctggggaaaaacttctgtgctactgctttggagttgcaggtgggtgggcttagtggcctgttcctcttagagtgacaccactactttatgtacagagcactagatggggatagtagtctctggagtcttctcaacttggctctttctggatgcaacagtctgccttaggagtgaggtgggatgaaggctattgggtccaatgttgttagcctgctggaattagtgtatagctaccaccctatgagtggcaactgggcagaggaagagcacccagacctctcatgatctttcccagaacagagcttctgtaacccagagctggagggaatgagaagtgctggtatcctgccactcctagtgagatatcgctggcctggagtgggagttgagggatgaaggagccttatgttcttggctttacttgcctggggtagaatttctatcatgctgaattggttttgtgtgtgtgaggcaggcgtgagggggttggggtaagtaattatctattgccatagactattgctgttctttttgagtaaatgtttctttatttggtgttgctcttagcaaaattttcttaggttaatggttgctttttataatttttaccaattatagttcttttcctagtgggagtgtttgtggaactcctcatgttaccattctgtaagtgagcttcatacttttttcctttttttttttttttgagacagagtctcactctgttgcccaggctggagtgcagtggtgccatcttggctcactgcaacctccgcctcccgggttcaagcaattctcctgcctcagcctcccgagtagctgggactacgggcacgtgccaccatgcccgggtaattttttgtgtttttagtagagacagggttttgccctggatcaagccaggatggtcttgatctcctgatctcgtgatccacccgccttggcctctcaaagtgctggagttacaggcgtgagacaacaccacgcctggctgagcttcatattctttagaaattaattggtattataatccatggttttggagctgctacatatactatactaactatactttacgtattagctatgtttatgtatataataattctaacttctaattgtttgtatcagggctttagagtagttatttaatatttatttatattgtcatgcacctttactacatatccattcattcagatcagttataattgtgagcatatatttataatattttctctcagaattatactttaattaaaagaacatttatattaattttaatgtttcacaagatgcattgtaattgtaatttttgattacacaaaaaatatatatctcaaatatatatatatatcttgagcaaatgtacctattcatcaatgagtgcaatctatagactccacttaggtaaggtacaaaaacagcaaatgaatttatgctgttagaatagtggtaatattcttatagttttttatgtgagtgctgattacttagttgtgttcatgttgtgaaaaatcattgagttttaggcttctgatatatgcagttttatgcatgttatacttaaataaaatcttaaaagtttattatggagtccatatgagttacacagttttaaccaaatatagtttagactaaatttactatatttaactttttacttatttggtattttaaaatgatgttttgggcctctagttttaagatggcttgtttcctatctttgtaaatgaaaaaataatttataatataaattattatgagtattaaaaattctttttgatattgtgtctcctcaaagcattttaagatgctatgagcctcaaaatatttttttttgaaatattgaagtttagaggtcatttataaattgttaaaaaatatgtttttttcccccacaattccagggaaacctctatatgcaaagtagaccctttatataacatatataaaatcagggaggtcattttatcctttgtaatacatttttaaattttattctgtaggactattttgaaagaaagtgggtttgccagataccttcattcagctgttcttatcaatggagctatgcttatttttggaggaaatacccataatgacacttccttgagtaacggtgcaaaatgtttttctgccgatttcctggcatatgacataggtatgtatctgttaggattgtacaaagtaggaaatatcagaaattttccatatagatattctcaaatacattaattgatagcatgtgtatatgtcattttagagttaagtgatagaatatgaatggaattctttctaatttcagcacagtagtattatagtaatagagccaggagaacagaagtactgagcagaagtagtggtagatacagggaatacaaaaagctagatttggatgtcctttttgaagactttttatgttgtttccctttgtgaacactatatcagtttattgtgtttgctacatattaattttgataatgggtagatatggaatactgttgaattatgtaaatttttatacatagtaggaatgtaaacattttagattttaagggataagcaaaaatatattaaacatttccgatatacttactatatataggaatctgatagaactagagaaaggaatagagatagtagagctaaagaaataagattttgagacgaaatggaaacccagatgtatctgggaaacaactatataagcatgttttcccaaagaactaaaaacagtttgcatttatacaattcacctaattttagttacgcaatataatcctatcaatttctgaatatttaagtgaatgtatttattgaaatactaaatttaggtatccagtagacccttgtagtgaaaacattgtttttctatgtatcatattatatataaaacctagctgatatttaaaatatacttatcagtacttaagagcaccttttattgagggtataaataaagtattataccaatttgaagcgattaggaaacatttttataagtaaaataaaagaataacacatttaatagatgtaagaagtatactttttctcttaaacctcataaaggcacataatctgctttggtaaattatttcaagtagaatcatgtaaagaaaactctgactattaataagcactttaatctttttactattacagttgtttcaaaggaaattcctagtagtaaagttaagcatggtttttaaatctaagtaatgaatgtcattctgtgattaatcatttgatactagtaatttgatctttttctttttgaaataataatttgaagtggtaactcctgacgaacatgggattgtctcagcttttaggaggctcatgaatcattgtttgaaattagtaaaatgggttgaatgaagtactgaatctaggctggcagtgactttatctcattgctagattgggcctgtcaatatattattgttttggctatggtgataagaccctgggcttatttttctggaagttgatgaaagttttgtttgtttgtttttcttctggggaaaaaaaatcccacaaaaagtatacattgttgttgtcattgttaaaaatccatgaagtggaattttgaacttttgcaaaaggttcttcaaggagcttccacacaatgtctgtacttcaatgaagaatttaaggttgagctattttctggctgacaaaatgggaatgtatttttatttttttcatattgttgaagattatgatatatcaagttttatgtgtcaaaaaacttaagtgaaaaaatttggagaattttgtttcagaaatagaaagatgtcagattatgatgattctaattactactatttatttaatttccttctatgtgctaggtactatgttaagtaatttatatacaaaatctttaacctaccttgtagcatggtactattatcctaatattcagaagattaaacagatgagagtaacaggaacttgccaaagccatgcaggtagtaggcggtagatctaacttttgtaactcctaaaacttgtggtagtctttctatttgactacatcatgctgattagttgggcccagtgtatgttcttaattatggcaacaaattaccttattcttagtaatgcttgtttcttaatgctgtagaaatatagaagaaaatatgagttccattttttcaagcaagttgttcagactggaggaaggaatagcatattttaaacagttttacattttaacaaaggtttttttttatcccctgtgctaacactgacaacaaaaacataaagacagttccacaattcaacataggttaaaactgttcggctttatctcatttgattatttgtaggtagttctcaaaaatgttctctaaaataatctgtttgatcctcctgggtttggagtatgaaatgttggactatttttctgggaaaaggtatttttcatattattatttatacttcaacaaatgtctttcaaaataattgttttcctcatggagtatgtttttgtggaaatagatataagcattatatagtaaaccaattaggaaacagaaaaagtgtcatgttgctagtttttcttttcactgtggtacaccaggacatttttggtgcatttatggaaggcacttaaaagcttagctgattgttttgtgttatatgatatttaaacaggaatatttgtaccatttctaattttttattgttgcaaaatgtattatttgaacattactctcacagtaaattttatacagtcaatatcgctaatctttgggtatataaccttgccttcacagttcccattctattattgcatgatggatgtagaaggcatatgctggtgattttcaatcatgctcataccttggcatcctctttggaggttggttggaaaaaaaaaataacttacgtaatcagattctttgagattggatactgggcatctatgttttttaaaagtgactaaagtgcagctgataatacagctagggtggtgaataagataggttgagtataacacatagcatgacacatttcttaatttgactgtaacatatgacatgacacatttcttaatgttctagtttgtaaatctagtttgaggtcagatttgagaatccaaaaacttaatttttttttgttattgttagtgctgttattattactttcagaaagccactatggcaccttcttcaaggttaacaagaactttctggtaaagataaccttctatttagaattcacacagaattctgaaacaagatgcaaaacaacttattgactatgtttttttcttaatcaaaaagataatagaggataacagaaacatgaaaatgtaatttcctgagttaaattatttaagaatgggtagggaataggatttgtataagaactatatcttgcagaaagcagaacagctgaaatttcaaatgagatttaacgaataatcgagttttcaaaataaattccctgaacatagtggtttacttatgacattaatttctttgtagtgattatttaaaaactaaatcagtaaaaactaaaaagtaattttttatttgggaaagtaatattttaatggtagtatataataatgtatattcttaaccattttataatacagtgaaattgcagttctgtatactcttaaaagatcacttaactggccgggcacagtggctgactcctgtaatcccaccactttgggagcctgaggcaggctgatcacctgaggtcgagagtttgagaccagcctgaccaacatggagaaaccctgtctctactaaaaatacaaaaattagctgggtgtggtggtgcatgcctgtaatcctggctactcaggaggctgaggcaggagaatcgcttgtaccctggaggtggaggtttcagtgagccgagattgcgccattgcactccagcctgcgcaacaagaccgacactccgtctcaaaaaaaaaaaaaaaaaaaaaatcacttaactaattaatgaagcctgggatacctgattttgtccaactgtttggagtgatatatatgtatacatatataatagatatagtttggtaaggcatataatttcatagcaaaatcatattcaaattaagacatctaattatttaattttttggaatactcatgcaaagttatgaaaattccaatctgcttgcttttcatgtttataattatttttattttctggaggttattttattagttcctctctctgtttatccgtatttctctatgcacttcgttaaattcttagggctctttcttgatgaaagtggtaccacttacctggccatctgaaagaaacaatttctttgtagatcaggaaaatccttagaatcatcacacatttctttcaatgaatttagccaactgtcgactgttttaagcttcattgtatcctttgctcaaggtgttctctttctttttgttgggattatatacaagaaatagtagtttaatcttttttaaaaagaggccactaaataaaagaaaaaataaccttttattttgaggaaaggatgaactaacatttatctaatgttttcaacagtgcttggcatgtcacacatgatttataatataattattgttacatctgtgtagtgtacattagtatatttaatttatagaagaagacactgtgatttaccatggttaaacccaaactcacacaggctataagatgttgtattcagaatttaaagttaagtctacattcagagtccttttgatattaacactatacaccgtgatatttatttttcctggtttaacaggaaaaaaaaggaattttagttggaaagaacttgttagtgtagtgagacattcaaaaatagtttttatcaatagatttaatcatatttctgagaggtatttgaatttcactctacctgtccccctcccgaataagttgattggaaaatagtgacctcaagatagaaaatccaggagaaagaaaaggataatggataatgaatctctctcattcttaacaagtctgtatccattttgagagactgtattgaatacaaaaattactgaataaagattaatgaaaaaaatgctctgaaaaagcagcctctttaataaatagttctgggaaaagttgacattcatttgcagcagtatgaaactagaccctcccctctaaactaaaaatggatcaaaacaataaaacaacagaaaacaggaataatccttcaagacatgggtctggagaagactttctgcaaaaggccgcaacagcacaggcaacaaaagcaaaagtaaacaaatgggatcatataaaataaaaagcttttgcaaagaaaaggacaatcaacagaatgaaaagacaacctccagaaggggagaaaatatttgcaaactattcatctgatgggggattaacatccagaatatacaaagaactaaaaaattctcaatgataaaaaaaacctcaacaaacaatccattttgcaaatgtttaacaaaaataggcaaatgatctcaacagatatttctcaaaagaagacatacaagtaaccaataatatatgacaacatgttcaacatcagtattcatcagggaaatacaaatcaaaacacaatgaagtatcatctcacgccatttaggatatctattatcaaaaagacaaaaaaataacaaatgctggtgaggatgtggaacaatggggaaatgtttttgatggaaatgtaagctagtacagccactatggagaatagtatggaggttcttcaaaaactacaaatagaactattatacgatccagcaataccaccactggatatttatccaaaggaaagaaaatcagtatattaaagagacacctgcacctccaggtttattgcagtactattcacaacatccaagatatggaaccacctaggtttccaacaagggatgaatgaatttgaaaaatgtggtatatatacatgctgaaatactattcagccataaaaagaatgaagacctatcatttgtggcaacatggatggaactggaagacattatgttaagcgaaataagccaggaacagaaagttaaacactgtatgttttcactcatatgtggaagctaaaaaaagttcatctcatagaagacaaaaatagaacagaggatactagagtctgaggagggtgggggaagtggtaggttacacagagagatttgttaaagaatacaaaattacagctagataggaggaatacattgtagtgttctataccagtgtaagatgacaatagttaactattatgtgtagtttcaaatatctagaattaggatattgaatgtttctaacacaaagaaatgataaatgttcgagatgattgatatgccagttaccctgatctgatcactatacattatatgtattgaagcatcactatatactccattaatatgtacaattatttctcagtaaaaaatgtaaaaaaggaaaaaagttttaaaaagtcttaactcttgggggaagaaggcaggacaaagaagtcatgaatgtagaataaaaattttaaaataaaatattaacacataggctccaaccatatttcaaaagtttaataaactatgatcaagtaggattcattctaggaattcaactgtgattcgttatctgggaatctataaatataatttattagttcaaaactaccaaagcaacaggacatatcattgtatgttaagacactataaaataatttcgcctactttgcctggcagacagtaaaaaactaaataaatatttatttaatgaatgccaggggacaattcctgagagaagatacgggtatgaatgagtttttttttaaactgagaatgagttaacctagagtaaattgtgcttattttagaatattaaaagaagttttgaagtagggagccaaaaaacaaaaccccagtaaagtaccatcatttcaggggcaggtgggaaaagatatttggcaacatccagaaatgtaattttctattacagaagttttgaaatggctaatataggtttttctttatattcatcttgttgtgagccttgtacatacaacctatgtgtactttctgtcttatttcaaatttgcatttaagactaacttatgaattggcattttaagtgaaacagtaaaagatttttatttttttttgagttggagtgcaatggcatgacctcggctcactgcaacttctgcctcccaagttcaagtgactcttctgcctcagcctcccaagtagctgagattacaggcgcctgccaccatctccggctaatttttgtattttttttgtatttttcagtagagacaggatttcatcatgttggccaggctggtcttgaactcctgacctcaggtgatctgcctgccttggcctcccaaagtgctgggattacatgcgtgagccaccgtgcctggccaaaagattttttaaagtgtctttacagtaatacagatatatatatatacacacacacacacgtttatatatatgtatatgtatattgtgaaaaaacatgagcatttatggaaaaattagccagtgaatttacattttccacttgcattttttaatgtataattgttaaaataaatcagtctgccttcagcttgagtttttaatgtaattatctatccctcacgtgtaaatagttttgatggtatagtaccgtttgctcaaatttgggtttgagagaacagtaactctaattttttgatcttatgtgtattgagtatatggttcataattaatatttagtaccttaaataatgagtacattatgttattttattttttatttttttaagcctgtattccagagagtgtatattatcttggtcttcattcttttcatcgtggctgttttgttggtatagaatattatttctgtaattttcatgatgtcagtaactatggaatttgctttaatttgtttggccttgaactgtttatgaagtgataataacctaagtgctccagaaatatattttcttcttggcaagaaatataaattatagtcagacagattaaaaatgtaggagactttttagtgtaagaattggtttagactacttgtaaacacattatatttatttagtattgagctttaaggcatttgatttatgcccacatatcaagctggcatatttgtgttttcttcctcttgttatctggacagcagagaattccccatatggccatagggaggggtgttgatgtaacagtggtggatgacatagggatttgagctacatacttacacagattgcttgtgccctgtgtttctgctcatacttgatcatgggtaccacttccattttatattcttagggttattggtaacagaactagctcatgattgcaaactctcaacacatagtcacttgattacccatggtcaagcattctatttttatctggacccagtggcatggcagtaatagaggtatataactttccaccacagatggtatggcctttgacatgtgtgtgaagcctgcattgtgattctttcactggggcttgccataaattccacatactactttttccaacagtgacactaccaataactatagtatgtactgggtcatatgtgcctagctgcagagttgcatgcagggtagacttcactgacagcagagctatttcctaccctggctggaaagagctggcagcctttaatgtcttccagtatatgggctgaagcagcattcctaggagtggaatatgctgcctttagaacacaaagaggcctaccagatggtttgctttcttctttgtaatgggagttgcaagatgcataattggtcttttaattcagatgagctgtctgagaatgttcttgtccactggacccctaaatattttaccaatatcaaagtctctgaatctttgtaggttttattttccatcctttgaagcatatgtcttaagaaggtctctgttgcattattcttgcccatctggcccaattagcataatgttgttaatgtagtagaacaatgtaatgttctgcaagatgtccaacaggatcaaatgtattctgactatgtatgacaaaagagggcggaattaatatcatcctaaggcaaaagtgtgaaggtatactagtttcccctccatgtgaatgcaaactatttttgatcctcttttttgatagttagcaaagaacacatttgccgactccatggccatgttaatcttctctaataaagatatacatcttgcacgacacctgcaattttagttctacttggtagtaggtgtctgctatcctttaagctttgtttagtttgccaaactgatgatttaaatggagatttgatggggtccattatcctggcattatttagattctttagggtgatactaattgcttctacccactctctctggaatgtgatagtattttaaaatttattgtattatccaggggataaaagctcccagaggcttccactgtgagaaccaaagaccaaatgtggtaggtgttgtgccatttgttaagcctgtttattccaattctatatccagcgactgaagacatgatcactgggtgagtctgtgacccagtggacccattttgagctggaccttgtccagctgttttcctattgtctcccatcattgggctaagttctgttacagttgctcctactatcagctttggtctatggaggaaagccacgaaattcttagtgatgctagtgtctctcccaccatcatattcttcatggctttggtaattggcatatcctctggccctttccatagataaaatagcctggtgggttttctggcatcacatagtgtattgacttcagcatgtgcacatttttagacttttaatcactgcctttactgtttgctatggcagttccggcattttgaccttacttagcatgggtatacttttcatgttttacatgtttctaagagtcatccagatagcaagtgaacatcacctcttgtggcatccttgtcagaaaggaaaatcctgcatcttggcagaaggctttcaaatcagtaaactctccctaatccaatcataaggttctggccaccttgatcaagctcccctctgaacctagtaccacttgtactctcccacctcctgccaacatgtgctgtctagctgtctaggtttgttgttgttgttgttgttgttttgagacagagccttgctctgatgtccaggctggagtgcagtggttcgatcttggctcactgcaacctctgtctcccgggttcaagcaattctcctgcctcagcctcctgagtagctgggactacaggcgcccgccaccacgcccggctaattttttgtacttttagtagagacgggggtttcactatgttggccaggctggtctcgaactcttgaccttgtgatctgcccgcctcgacctcccaaagtgctgggattacaggcgtgagccaccgtgaccagcgaaggtcttatagattctttggtcgtatactctctttctttccttagcagtcccagcatgtacctagatgagttatgttgatacccaacccaagttataggccctctggccagtactgaagatgtgagcagattctgccctgcgccacaggtcatgctggagagtagcctctacattgtgtttaagcaaaggcagagtgctatctgtcttttaggaaggtaggatggatcatttctgcagtgtcagatgattcaggaaaatttgggaattcaaaatttgggaagactttaaggagcatcaacttctgatattcccattttgtgtgtcagagtcctttttcttctggggcttgaccttctttaattgacagatcttctataattggcagtctcgttatatggtactgaggagaccctctggctttatcagcctttcattatctttttctagagctcactggggctaagcagtagacatgcaattctagtatcttaatagttacccttcctcatgtttttcaagcatctagtacttcactcctgctatactattcccttctattggcatgccttcctactttatcactagtttaagtttttgcagttgcttaatggccactttgtgccaagagctatctgtgctccacctaccaccaatgatgagtttttcattgctagcctggcaatgtatgatccagctctcaaactccaacttatttcttactttagtataccattcctgaaacaagtcagagtttgagtcctctggaaagcagactctgaggtagagtttagtattcatgatgttaattgggagtacccttacaatcaatgcctttgcaagaggtagggggatgatgcagaattggacaaagggagaagttgagttgtgatgctcgatggataaccttagtcaaccctgtaaggattgactgaaggcaaaataattggtcatacttctccaatgttgggctggaatggccaggcctttataccaatacattgatcagtcattcaatatgggtcattctaggaagggtgtgcccttgagtgaagtgggcctgtgttcctcaggcagtttgtgaggtagcttgcaactgactcttcactgacagcactgctagcaacccagacaacaagtttttttttgaattatgatctgggcagcatatatccatgtctaccagaaatatccaaacttcagatgattgacaccaaataaaaatttatttttcacccattatacatgttcatcattggtgggcagggcagattttttttattattattatgctttaagttctagggtacatgcgcataatgtgcaggtttgatacataggtatacatgtgccatgtcggtttgctgcacccatcagctcatcatttacattaggtatttctcctaacacccatcaactcatcatttacattaggtatttctcctaatgctatccatccccaggcccccaaccccacaacaggccccattgtgtgatgttccccctgtgtccaagtgatctcattgttcagttcccacctatgagtgagaacatatggtgtttggttttctttccttgtgatagtttgctgagaatgatggtttccagcttcatccatgtccctgcaaaggacatgaactcatccttttttatggctgcatagtattccatggtgcatatgtgccacattttcttaatccagtctatcattgatggacatatgggttggttccaagcctttgctattgtgaatagtaccgcagtaaacatatgtgtgcatgtgtctttatagtagcatgatttataatcctttgggtatatacccagtaatgggattgctgggtcaaatggtaattctagttctaaatccttgaggaatcaccacactgtcttccacaatggttgaactaatttacgcttccaccaacagtgtaaaaacattcctatttctccgcatcctctccaacatctgttgtttcctgactttttaatgattgccattctaactggtgtgagattgtatctcactgtggttttgatttgtatttctctgatgaccagtgatgatgagcattttttcatgtgtctgttggctgcataaatgtcttcttttgagaagtgtctgttcatgtcctttgcccactttttgatggggttgtttgtttttttcttgtaaatttgtttgagttctttgtagattctggatattagccctttgtcagatgggtagattgcaaaaattttctcccattctgtaggttgcctgttcactctgatggtagtttcttttgctgtgcagaagctctttagtttaattagattccatttgtcaattttggcttttgttgccattgctttggtgttttagtcatgaagtccttgcccatgcctatgtcctgaatggtattgcctaggttctcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccttttcttgtttttgtcaggtttgtcaaagatcagatgtttgtagatgtgtagtattatttctgagggctctgttctgttccattggtctatatctctgttttggtaccagtaccatgctgttttggttactgtagccttgtagtatagtttgaagtcaggtggcatgatcctccagctttgttcttttggcttaggattttcttggcaatgcggactcttttttggttccatatgaactttaaagtagttttttccaattctgtgaagaaagtcattggtagcttgatggggatggcattgaatctataaattacctttggcagtatggccattttcacgatactgattcttcctatccatgaacatggaatattcttccatttgtttgtgtcctcttttatttcgttgagctgtggtttgtagttctccttgaagagaactccttcacatcccttgtaagttggcttcctaggtattttattctctttgtggcaatggcgaatgggagttcactcatgatttgactctctgtttgtctgttaatggtgtataggaatgtttgtgatttttgcacattgattttgtatcctgagactttgctaaagttgtttatcagcttaaggagattttgggctgagatgatggggttttctaaatatgcaatcatgtcatctgcaaacagggacaatttgacttcctcatttcctaattgaataccctttatttctttctcttgcttgattgccctggccagaacttgcaacactatgttgaagaggagtggtgagagagggcatccctgtcttgtgccagttttcaaagggaatgcttccaggttttgcccattcagtatgatactggctgtgggtttttcataaatagctcttattattttgagataccttccatcaatacctaatttattgagagtttttagcctgaagggctgttgaattttgtcgaaggcctttttggcatctactgagataatcatatgattttgtcattggttctgtttatgttatggattatgtttattgatttgcgtatgttgaaccagccttgcatcccagggataaagctgacttgatcgtggtggataagctttttgatgtgctgatggatttggtttgccagtattttattgaggattttcacatcgatgttcatcagggatattggtctaaaattctctttttttgttgtgtctctaccaggctttggtatcaggatgatgctggcctcataaaatgagttagggaggattccctctttttctattgattgggatagtttcagaaggaatggtaccagctcctctttgtacctctggtagaattcagctgtgaatccatctggtcctggactttttttgtttggtaggctattaattattgcctcaatttcagagcctgttattggtctattcagagattcaacttcttcctggtttagtctcgggagggtgtatgtgtccaggaatttatccatttcttttagattttctagtttatttgcatagaggtgtttatagtattctctgatggtagtttgtatttctttgggatctgtggtgatatcccctttatcatttttattgcatgtatttgattcttctctcttttcttctttattagtcttgctagtggtctatcaattttgttaatcttttcaaaaaaccagctctgggattcattgagtttttgaagggttatttgtgtctctgtctctttcacttctgctctgatcttagttatttcttgccttccgctagctttttgaatgtgtttgctcttgcttctctagttctcttatttgtgatgttgggtgtcgattttagatctttcctgccttctcttgtgggcatttagtgctataaatttccctctacacactgctttgaatgtgtcccagagattctggtatattgtgtctttgttcttattggtttcaaagaacatctttctgccttcatttagttatttacctggtagtcattcaggagcaagttcagtttccatatagttgtgcggttttgagtgagtttcttaatcttgagttctaatttgattgctctgtgttctgagagacagtttttttgtgatttctgttcttttacatttgctgagtactgctttatttctaattatgtggtcaactttagaataagtgcgatgtggtgctgagaagaatgtatattctgttgatttggggtggagagttctgtagatgtcttttaggtttgcttgttgcagagctgagttcaagtcctggatatccttgttaacctctctcattgatctctctaatgttgacagtggggttttaaagtctcccattattattgtgtgggagtctaagtctctttgtaggtctccaagggcttgctttatcaatctgggtgctcctgtattgggtgcatatatatttatcatagttagctcttcttgttaaattgatccctttaccattatgtattggccttctttgtctcttttgatctttgttggtttaaagtctgttttatcagagactaggattgcaatccctacttttttttgctttccatttgcttggtagatcttcctccatccctttattttgagcctatgtgcatctttgcacgtgagatgtgtctcctgaatacagcacactgatggatcttgactttgtcttttaattggggcatttagcccatttccatttaaggttaatattgttatgtgtgaatttgatcctgtcattatgatgttcgctggttattttgcctgttaattgatgcagtttctttgtagcatctatggtctttgtaatttggcatgtttttgcaatggctagtcccgtttgtttctttccatgtttagtgcttccttcaggagctcttgtaaggcaggcctgatggtgacaaaatctctcagcatttgcttgtctgtaaaggattttatttctccttcacttatgaaggttagtttggctggatatgaaattctgggttgaaaattcttttctttaagaatgttgaattttggcccttagtctcttctggcttgtagggtttctgccgagagatctgctgttcgtttgatgggcttccctttgtgggtaacttgacctttctctctggctgtccttaacactttttccatcatctcaaccttggtgaatccaacaattatgtgtcttggggttgctcttcttgaggagtatctttgtggtgttctctgtatttcctgaatctgaatgttggcctgccttgctaggttggaaaagttctcctggataatatcctgcagagtgttttccaacttggttccattctccccatcactttcaggtacaccaatcaatcaaatgtagatttggtcttttcacatagtcccatatttcttggaggctttgttcatttctttttagtctgttttttcttactttttcttctcgctttatttcattaatttgatcttcagtcactgataccctttcttctacttgattgaatcagctattgaaacttgtgcatgcgtcatgaagttctcctgtcatggttttcagctccatcaggtcatttaaggtcttctctacactgtttatcctagttagccattcgtctaatctttttttcaaggtttttagcttccttgcaatgggttcgaacatcctcctttagctcggagaattttgttattacctaccttctgaagcctacttctgttaacttgtcaaagtcattctccatccagctttgttccattgctggtgaggagctgtgatcctttggaggagaagaggcactccaatttttagaattttcaccttttctgctctggtttctccccatctttgtggttttatctacctttggtctttgattttggtgacctacagatggggttttggtctagatgaccttttgttgatgttgctgctattcttttctgtttgttagtttttcttctaacagtcaggtccctcagctgcaagtctgttggagtttgctggaggttcactccggaccctgtttgcctgggtatcaccagcggaggctgcagaacagcaagtattactgcctgatcctccctctggaagcttcatcccaacggggcagccacctgtatgaggtgtcggtcagcccctactgagaggtttctgccagttaggctacacgggggtcagggacccacttgaggaggcagtctgtttgttctcagagctcaaacgccatgctgggagaaccactgccctcttcagagctgtcagacagggacttttaagtctgcagaagttgtctgctgccttttgtttagctatgccctggccacagaggtggagtctagagacggtaggccttggtgagctgtggtaggctctgtccagtttaagcttcctggccgctttgtttacctagtcaagcctcagcaatggcggatgcaccccccagccaggccgctgcctcgcagttcaatctcagactgccgtgctagcagtgagcaaggctctgtgggtgtggtacctaccaagccaggcactggagagaatctccttgtctgctgattgctaaaactttgggaaaagcgcagtatttgggtgggagtgtcccgtttttccaggtagtctgtcacagcttcccttggctaggaaagggaaatcccccaaccccttgtgcttcccgggtgaggtgatgccccaccctgcttcggctcgccctctgtgggctgcatccactatccaactagtcccaatgagatgaaccaggtacctcagttggaaatgcagaaatcacccatcctctgcgtcgatcacactgggagctgcagactggagctgttcctattcggccatcttggaacgcctctccagatttttttttgtcattatttagggacccaggctgacagaagacataggctttcattgctaatcaaatgcctccaaccagaaacacagatattccagtagcttgcattacattgatacattcaacttctagggattgtaagagtataattttgtgccagaaggaaaggaactgaaatattttattgaacagcacaaatgtctatcaaaagtattgtatgtaattcttttttaaacttttagtataattgaagattgaagatgatgtcttggagatagtaataaagctgtcacttcctaccgctacatgtattgaaaggcaaataacttctagaagtagaattatgttttattattatttgcctaaattaattgccttcatgtataattacattactattactgtactgtaatgtttctcttctgcaggacttgtgtactttaaaaacaaaacaaaagaaaaccagaacatgactgagagcataagcactattttgtaaacagtgggattaaatgaaagtatacatacttaagagtgaaaccctctagctaccctttatccacttagggtcttcctaaaatgctgttagtccgatttatggtttccaggcaggagactggaaaattatctgaagaaatctgaccagcctaagagaaagcatgtagagatactgacatttggaggtctctaactgaaatggttccacctgatcagaatcccagaggtcaacatgtccttcttaagcactaaattcctaatgactctggtggtgcctcactcttaaatttgcagcctgttattattttgacaattacaaaaagttactaaatttgatcaaaatgtcaaacgagtaggaaaaaataagaaattaggggaaataaagataatccacagaggagattataagttaaatctttatggacagaagatgttacatttgtgaagcaaaatgtgagattttaataaaaatagttaattcagaaaagaaaaaaatgagctcttggaaattaaaattaggaaaacaaatcaatgatttgaagataaagtgaagaatctccataaagtattatgaataatggacaaatggaaaatagggtaaaaaatgagaaatttaatatgactgttccagaaaactttgtatctcagtaatagaattgaaaaagcaaagaacataacattttagacaggaaggaaattatcaagtgagtaattcaaaaatatgtttgggattgaagtacacaaattttaagactaaaagagcctactgagccccagaaaaataaatacaaaagactcacagcaaagctcattacaaaaagacaaaaagaacctaaaaacttatatagagagaaaagaaataggacaaataaatcatgagacttgatagcatagtgccttacaaaagcaatacgagaagccagaagagtggactaataccttcaatatctgaaaatgctttccatgttagaattctaacaccaatcaaatcatactaaaagtgttagagtgaaataaaattattttttagaattgcagattctcaaaaatatacctccaatgtacactttatttagatactttaggattatatctcctattgaagtatgagattaaataaacagatgaaatctaagaaatggaatatataacaggggagaaatatggagggaatccttatgatgatgtaataggcctagagagcagtaagttcagattggagaagaaagatggagtttcaggagggatgtctttacaaagtaaatgaaattgccagatatcttgatgtattagaagatattgagaagaaatgtacacatctggcaaagggttgggggagaaatagcagtagatatacagaaaggtaagcaaaaaagtgaaaatataatttgtggagaaagtaagttatttaagaataaaaatgtagtatgctacctggcttatctgtgaataatatcacagatatatactatcaaagataataaaaactgaacattagctgagtgtggtggtgtgcacctataattccagaaactctggaggctgaggcaggaggattgcttgagcccaggaattaatttagtccagcctaggcaatacagcctaggcaatatagcaattccccatctctaaaaaacaaataagaaactgaatattgctctaaacaaaattataatataaatgtatagagaatggagggagaggaaatatgcgtgtgtaagtctgtgtaagagcttaatcttcaccatctgaagaaggaagtcaggcatattatctgaaactgggaactaggcatgctgtttagaacagatgaaaatacaagaaacaaaaacaaaaacaaactctttatagctgtttatttagaattaaaagtgcttacctccatgattctggaatatgctttgggaagatagggggcagtggatttttttttttttttgataaaccttgtagaaatattggacttttgggcctcacacatgtatatatttaaaaatgataaaataaaagcaaagtataacagtacagaaattaaatgatgcacaagttagtggatcaaggataaatgttcaaaaattgggaaaattagtgcattgacatatacttggaaatatctggaaaatatgatatatgggaaaaattaagtttgatgcttaccagatatacaaaaataagttgcaaaaagattgaagaccaaaatagtaaaagccaacagaaaaacctttactggaaaattagagattatttttaaaatctcagtttactgagtaaacaagcacagatcataaggtgacctaaaggtaagaccaactttctgtaaaacaaggtttcataaactaagtgaaaaaaagatgctgtagcatggaagaatatatggtaatacatatagccagcaaaggattagtatccagaatatttaatcaagaatcctttaaattattaagaaaaagacaaaaagcaaatagaaaaatgtgcaagtcttaaacagtgatttcatagaagactaaaacaaataacctatacatgtgaaaataagttgactcaccagtaactggaaaaatgtaaaatcaaaccattcatcagattggtaaaaattttaagtctgatagaactacatgttgtagagaatataaaacaagaggaactgttgtacactgctaatgtgagtcaacacaactactttggggagcaaattgggaaaatctagtaaaatcgaagttgtgtcttttcttatacctcttggaaatctagagaaacattcaaaatatgcacaagatacatataagagtgaatataccaacatgacttgtaataggaaaaaaatctttaaaaaggctaattattaacagcttaatgggtaaatattttgtgtagtcataacatggaaaactctaacatggttacaatgagcacacagtaccacttgtatctataaatttaaatgagctgttgaattgacatttctccaaagatatacaaatgtccaataagcacatgaaaagatgctcaacatcactaatcattagggaatgcaagtcaaaaccacaatgatatactaattcatactcattaggatggctatgataaaaaaacagaagataacaagggttgacgaggatgtggagacatatgaacccttttgcattactggtaaaaatgtaaaatggtccagctactatggaaaacagaatggcagtttcttaaaaaattgaacacagaattactatatgatctgttaatcaaatggacctcatacaagttatttaccttcatgtaggtctgattcttcatttctaacatagggtaatacctgctccatcaatttcactggattcttataaagaccattttaagatatgcgatgaaaacactttggaacttttatgtgtacttaatttataaaagtatacagtttatactttatataatttcttttgcaccaacctaatagtgctacaaacatataatgtacatttattaaattaactctaacatgtaaaattggcagtcttaatctttatcataggcctccataataatattttctaaaatgtgatcttcagagcattgactcttgaggatcttaataggcattatgtgaaaagtgcttctttggataaaacattgggaaaacactgtgttaaataaagttaggttaggtttctgtacctttacactctctcttttgagaatatttaataggcagatataccatgtggactaaaaagacagattatacactttttcgggggagatttgtgtttcctggattatactttagcatatacaggtcaacatatattttattgttctcagtctttcagcatcattctctttttttttttaattatactttaagttctagggttcatgtgcacaacgtgcacgtttgttacgtatgtatacatgtgccatgttggtgttcagcatcattttctaaacttacagttttggtttttataattttttgatgttcattaataaaatattgagttgaaaccaaatttattttattattgttatagatgtaattacttaaataagaaaacaagtaattcattactttaacttttacaactaactgtacttaagattattttcttgttccataaaggcttttacctaaacaaaattaatttgttttaaaaaatcttgtatctatatgctttcatgaaataccaaagcatgcctttataaatatgacatttctaagaagttgaaatctaaaacactgtattgagaatgttcctagtcactgaatgatgaattattttaaatctcaaatttacgttagtatatatgtcagttctgagtttatattgaaataatacacatttttcttaaccactttccatagtttctatatagttcatagattatttatgattttcattttttatctagaagttttgcagttaaaataattcccttctatataaaaaagcttttttgagaattcaaatcattaaagtgatttaaatgttttatcctgatgattatatttttaggtattctttcagtgaacattgtatctgccattgacttttgtatgcatacatgtcatatttgatttagtatttaactttcaaagaggtgtgccctatactgacattcataagttttacttggaatatttaataaatatatgtcttcgaaattatcttccaatataaaatacctctaagttcattcttttcattttcttgttctcatatgcttaaaattatttgtgagaattctaggcaagagttatttttatttaatgaataatgttagttgagtaaatacactaaattgtaggtcatggaaaattaatgagaatttttttttgcttcctgcttatgcatagtgtatctttaattcggccaatgatgttttcatattatttgtcttagtttattcttttatttcattttttgtttttctgttttcttttttctagcttgtgatgaatggaaaatactaccaaaaccaaatcttcatagagatgtcaacagatttggacactctgcagtagtcattaacgggtaaaagaagcacatttccaatttttagagggtcacttatatcagtcatactatcctcatattctggtattctttttgaaaattatcattggtacttaatggtattggattttatgcatctcttctctaccatagaatgcattttgatttgtcaatcatatctttttttcctttcttgtttaatatatttaagggacatgggagtaggtaaaggaaaggtgctgagataagacatcagatacccttttatgtcatcctgccttcttttctttttccagagatcagataaggaatgactcttcttttaaaaagatggaactgaaatgatagagaggctagccccatatttctatcaaggagaacaaggaaagtgagaagaattagattctcattttagttctgtcatttactaaatgtgtgatttttgacaagtctcttaacctctctggaccttaaaatcattatatccattgagaaattggactcaatggtcattacattgccttccccatttaagttaatataatttttgtatttctatggcaaaaatttggtaatttggaatccagtgacagtaaacaatctgctagctcatttagtggcttaacatttgtaaatcagaatgacctttttataagcccattttattaccaccttatcctaaatatgtaaaaattctccactattgccacaaaatgacttaaccacaatgaaactgtgtaactgatatcaagtggctgtccaaacagtaatacatgaaaactgtgaaacataaaacctccagggttctctggttgatttttattttacttttttaaaataataaaagacattcttgaagacttttttgactgattcaatttattatgttaataatatttttgacatgaaaaatatgctgttttaagggcattggcactgcttggtattaatttagtattgtctaggcttctctttccagactgaatttaaaaaatctttttgattattttactcttagttttcttattttaaaagaatgaaacaccataagaagaactcggtatctaatttcaaaattctgtgtctatattgaaaagttataattctagatagcagttctaaagtgtgtcttgtccatgtatagctattatctatttttttaaaacattgttttctatattattaaaaaaatacttatttttctgacaaaggaatattgtatataatcattgtttcttttcctttcttgtattaacaataaaacatgttttgaagacttagtgttttcttaatatattaagatttatagaatatttcatattttgtctggaaagtcttcaagaaattatatagtagttcctctggtgtttttatatcatattgtatgctagaaatatgattttaaagaacagtactaacagaagtacttaaaatagtataaaatgtatatttaaatctatgcttatttttataactaaatcagtagatagggacttttaatagcgtttctttaagattcttgttttgtttttaataggtccatgtatatatttgggggattttctagtgtactccttaatgatatccttgtatacaagcctccaaattgcaaggctttcagagatgaagaactttgtaaaaatgctggtccagggataaaatgtgtttggaataaaaatcactgtgaatcttgggaatctgggaatactaataatattcttagagcaaagtgccctcctaaaacaggtaaatttctttttcttttcgtctttgtggcagcaaaatttctcttctacagaagtagaaatatcttctgcttataagaattactttagtagctacagaaatgaaaaatttgtattaccctaattaggaattctaatgtttgaacctagtgattaataatttaatacatttattagctatttttagctttatttttgaaatctgtatatatagtatatatatcaatattttatatataacattgtcatatatatgaattattttctaatataagtttaaaatgctttccagtacatcatttctaagaagtgctgttagattcaaagaaataaaatgaaataatttattttccatgtggtatttttttttcttcctgaattattgccaaaccacaccataaagtaaaaaaatgttacagcatttcatgactaatgatctggttttatatttcttataaaatggtgaataaataaatgagacttatgaaaagttaccagtcaattattaatcagttagctaattaattatttggataaatattgtttagttttttaagtgctgagagtttttatacatttttgcggttacaattaataaatgtatttttaagttttactaatctatattaattcagatgtcttttatatctttagaaaggatgataaacagtatttgttatgatgttttcttttgtatgtatagtaatacactttgttcagtaaaatatatgtaaatcctttgactttctctaaaatacgtaaatttatttattttagtttattttttgagacagagtctcactctgtcacccaggctggagtgcagtggtgtgatcaaactctgtctcctggtttcaagcaattctgctgccttagctttccgagtagctggaattacaggcatgtgccactatgcctggctaatttttgtatttttagtagagatgggttttgtgatgttggccaggcttgtcttgaactcctgacctcaagtgatccgtctaccttggcttttaaaagttctgggattgcaggcatgagctaccgtgcctggcccaaaatgtgtgaatttaaaatgtctgtaggatccttgtatattgaataattaaaatgggggtaaaaggtcttgaaaatcctgtaaacacaattgaactacaaaagttgtcttaatctttagaaaacttactttgaaattgaaggtcatttctttggttaaaaaatgtcttagtgattcttaatgattcttaaatagatattgtaaattaagaagagtaagattttcttttccgtgctgatatatcgtcccccatttgtattatagctgcttctgatgacagatgttacagatatgcagattgtgccagctgtactgccaatacaaatgggtgccaatggtgtgatgacaagaaatgcatttcggcaaatagtaactgcagtatggttagtatttatgggtaaatggtgctgtagttacaacagactgctgctttatgatcattagcttaccatttagtagcactgtagaaaaaaagcactttacacattaagacatttagaaagtatatagggaatcattcacttcttggcaaattgtgaagttagattggtttgttgttcaaatttgtcagtctagattccattttggatccatcaactttacttcttttcatggatgagactgggaacattttttcaaaactgatattgaaaaagactatagctataaatgttgtcttctgttcctatgaaaataagattatataggtaggtattgaaataatttccattggattcctgtcagacatgcattagtggtcgtgtggtctagtgctttgttttcacactttgtgtgtaagtttaacctgagtttttggtagttgtagtttctcttttaactgtctatacattagtggttctcaagttgaggcaattttgtctcacaggggacattttgcagagacattttggttgtcacaaatgtggagctgctattggcatctaataggtagaagcaagggagctgctaaacattctacagtttgataagattttttaacgtcctttttcatctaaagtagagttttagcactattgacattttgagccctataattatttgtttatttgtttatttgttgtgggagggctgttctatatattgcagaataaaaaaacataaaatatttatggcagatgaaaatgggttaagagaagcaaaaattaagattttaagtggtagcatctaaacattctatgttatgtagaagatatcaacaaattgaagggaaaaattttaaaaagtagtatttagtagaattaaagatttttttgttttgttttgtttttttgagacagagtctcactccatcacccaggctggaatgcagtggcatgatctcggttcactgcaacctccacctcctgggttcaagtgattcttctgcctcagcctcctgagtagctgggattataggcaggcaccaccatgcctagctaatttttatattttagtagagacagggtttcaccatgttggccaggctggtcttgaactcctggcctcaagtgatgtgcccacctcagcctcccaaagtgctgggattacaggcatgaggcactgcacccagcccaaagattctttcatgggcctatagcttgagtaaaaataaatagcatggatacatatttccaactgaatataatgtatcattttttcttttttggaaattttattactgaaagtatctacttgtttttcaagatagcaggcagaggtaaaaggcaaagaaaagggagttgaaactaagtaaaaaatttgattgtataattaaaaaaattcttcactaattaataattcaaaatatgtaagttttatgactttaatctaattttcagaacttaaaatggagggaaatttgcagttactgactcattagattgaacccttttgttttcatacatactctgttgttatatactttccagtgatacaagttgttttaataacaagatatacttcaattttatttgagttttaacattaatataacatggttatgctttgaaaatttaaattacgtttgaagatatccactgatattcatctaatgggagttattttagtagaagtcggagttaaataaaataagacatgggaatcagggacttgtattacagttcttcagagaaacagaatctgtctatatatatatatacacacatacacagtttatatatataaataaataatatatatttgtttatatattatatataaatatataaacatttgtttatatatttgtttatatattatatataaatatatttgtttatatattatatacagatatataaacaaatatataaatcttttatatataatatataaatctattatataatatataaatatctgtatattatatataaatatataatatatatttgtttatatataatctataatatatgtgtatatatatatataaaatgagatttattataagaaattggctcatgtggttatgaaggatgaaaagtcccaggatctgccgtctgcaaactgaagacccaggaaagttgatgatgtaaattctactctacgtatggaggcttgagaaccaggagtgcagatggtgtaagtctcagtccaagagcaagaaaaggcagagagaggaaattctttcttcctctacttttttgttctttcaggccctcaattgcttggatgacgcccaccatagggagagcattttactttacttggtttaccaattcagtctcatccagaactgccccctacagacatatccagaaataatgcttagcctaatatgtgtccaccccatgtcttggaaaagttgacacataaaattaaccattacaagtctaccccttgtcaacttggcacctatacatatctacataaaccatacttaattttcaaatgaagataataacaaggtcataattctacctaacataatacaagtatcctgtgtacaactggaaaacacatcaatctctttcccagaaaaggaggtaaagtcctggagtgatatttactcctctccttgatattctgtaaattaaatactatgatgtaaaatcaacagtacttaaattctgatatgagcatcttatgttacatgatgagggaataagagaagaaagaaaacaaagatattacacacacacacacacacacacacacacacacacacacagatgtattcttagcaaaatgaggaggaaatacagtccttatttctgtaagtgatcatgtggttgtagctaatatttatacatatattcttttttttattatactttaagttctagggtacatgggcacaatgtgcaggtttgttacatatgtatacatgtgccatgttggtgtgctgcactcattaattcgtcatttacgttaggtatatctcctaatgctatccctcccctctacccccaccccacgacaggccccggcaattcctcaacgatctagaactagaaataccatttgacccagccatcccgttactggatatatacccaaaggattgtaaatcatgctgctataaagacaaatgcacacgtatgtttattgcagcactgttcacaatagcaaagacttggaaccaacccagatatccatcaatgatagactggattatacatatattctcacctaaccattttgtatttcctttaccttcagcaagcaccttacctgcttgtagttttttatctgttggggtgactcaaacctttattcttgaagggtcattcttcattagtagtcctgcttgaattggattgttgtagttttccattgatcttaatcacagggtaatataatttggacatttgtccctgcccaaatttctgttgaaatataatccccggtcttggaggtggggcttggtaggaggtgtttgaatcacaggagtggatccctcatgaatggcttgggccacccgcttgttgatacgtgagctcttgctctgggttcacttgaggtctggtcgtttaaaagtatgtggcaactccacctccattctcactcttgctcctattctgccatgtgagatgcttactgccactttgccttctgcaatgagtaaaagttccctgaggcctctgcagaagcagagcagatgctggtgccacatttcctgtaaagcttgcagaactgtgaactaactaaacctcgtttctttatgaattacctgatttcaagtattcctttatagcattgcaagaatggcccaacacacagggtgtagggtatggtaatactgaaagacgccataagggatctcttgtattctagacatattcttcctagcctcctgtgtgaagtggcagttcagtttccctgtactagaagcagtcaccccaatgagcacagtaactcttctttgactgatgatttagaggtgtaaggaacccaaagtggccaagtggcagtcttaatttccaattctatggaatcagtgttgtgttttctggaaaaaattattccttcctctggaattaagacatctaggtcagcaaagaataaggtcacaggaataggaagaaaaatttcgctaatgaattactaagggcagtagtgagtagtaccactcccatttccaccccttgattattggacccataaatgctggctgtgagagaaaaagcaccatatattggatgctgactcagagcttatatggctttctggagaacccttctgtcagccttgcaaggtattactacgtagctggcactgtaactgaatcatcaaaagcccattccactgttttatgaaacgagttgcttgacaattgtagggaacatgataagaccagtgagcataggcccattgctgtcctccatgtgctgtgacatgagttccttggtcaaaagcaattctgtatggaataccaagatagtagagaaagaattctgtaagtttactgatggcagttatggcagaagcattgtgagcgaggaaggcaaatctatagccagaataaatgtctgtttcagtaaaaacaaaatgcttccctttccctgattgaagctgtatcaaccttcctccaggtagctggctgattacctagggggatggcaccatatcaggagctcagtgttggtttctgctactggcatattgggtactcagcagtggtcatagccaggttggcctcggtggatggaagtccattttgctgagcccatgcataatctccatccctgccaccatggccactttgtccatgagcccgttgggtaatgacacaggtggctagggaagaaggtatccacagaagtggtcatcttatccatgtgattattaaaatactcttttgctgatgtcacgttttggtaaacatttacgctggatacaagtatcttcacttatttgccattcagtgagatctgtccgcatcccttttccacaatttttttttttgtcaccaattttccattcatgttccttccaagttcctgaccatacagacaaaccattggccacagcccatgaatccatacataattgcacatctggccatttcttcttccaaacagaataaacattgagaagcactgtttgattttgcccactggaaagatttcctttcactactgtacttcagggaggtcccaggaagggatagcagaacttcagcagtccttttttgggtggtacctgcatattgtgcagaaccatctgtaaatgaaaccagtcttctcttcctctgtcaagtgatctagggaacttctcttgaagtgataggtcagactgggagagagaaggcagtgtggcagaagtggggatcatgggcatttgggcctcttcatgtaacgtagttgctccttcagggcctccttgagcctgatcatgtatataccacttttatttgatgatagagtgccgctgtgcatacccaacctcatgggttggtgggtcagataacacccagttcatgatgggctgaaatcacataatttggtgacccatggttaaacattcagtttctattaaggcccagtagcagactaagagctgtttctgctaaaggatagtagttatctgcagaggatggtgatgttttgctacaaaatcctaagggtctgcactattatttgcctataggggcctgccaaaggctccaaacagcatcctgtctgccactgatatttcacgtaccattgcacctgcaggatcatgtagcccaactggcagagcttgtatagtactctggacctgttgcagagccctctcttattctgagatctacttggaattcgcagctttttagatcacttggtaaatgggtcaaagtaacataccccagtgaggaatgtgttacctccaaaatccaaagaggcctattagacattctccctcttttttgttttggttataggaggggccagaggcaacaacttaacattcacctttgaaagggatatcttgacatgccccatactgctagacccctagagatttcagtgagttagaaggcccctgaattttagatgaatttatttcccaacctctgacaccaaatatcttgccagtaagtctagagtagttgctacatcttgctcactaggtccaatctatgtgatgttatcaatattatggatcagtgtgatgtcttgtggaataaaaaggcagttaaattcctcagaactaagttattaaataggagtggagagttggtatactcctgaggtagaacagtgaaggtgtattgctaccattgccagctgaaaacaaactgcttctggtgatctttactaacaaatttcaagaaagaagcatttgccagatgtttagctgcttgccagtttccagggaatgtgttaattgcccaagcaatgaaaccacatctgataaggcaattacaattggtattaccactcggttaagcttatgataattcactgttattctccaaaatccatctgtcttctgcatagactaaataggcaaatttcatgggaatatggtgggaattaccactcctgcatcctttaagtccttgattgtggcactaatctttgcaatccctccaggaatggagtattgcttttggcttaccatttttctacatagaggctgttctagtggcttcttcttggcttttcgctccgtaattgtcctcactccacaggtcaaggaaccggtgtgagttttctttcagctgctgagtatgtctattccaattatgcattctggaactgggaaaatagccacaggatgggtttgggacccagtgggcccactgtgagagggacctgaactccactgatcatctggcagtcataagcctctgactggtggcccacagtgatgttttgggtctcctggaattaatgtcagtttagaaccagcatctggtactgatactgattatttccctttccccagtgcatagctaggatttagtaggatttctatatattttactcctaggagcaacttcatgctcaactcaccaatgccatagatgtaagcaagtcagactattccaattgctgctttaactctgctgttcatcatagtaacctcacccaccttgcctttgttagttgagtgctgctacctagcccctgccaacctagatccaattattcctgttgcatttatgtttcccaattcagtggctgcacttcccactgcaaggctgggcatacagaaaacagcaatcatggagctcttcaaggatgccagtgctcccctcccaagtttattcctttcaatactggtgaaaggtgtgtcttctggaccctctcagtgagggtgagcagatcttaaaggacaaatccactctaacattccaatctccctaagccattaaatgtcttctatattaaaccaaggcagatccagcatttccaagtcactcactgtgggccaccttttggtctatgttttagccaactaacagaaagagccctttctaactctccaagctataacatcaaatgtataatttctgcttagtgagcccatatcaataaattttgcctgatccaactttatgtttcgtctatcattttccaatacttttaccgttctggaggctgggaagtccaagatcttggtggtagtagatttggtatctggtgacggcctactttctggttcacagtagatgtcttttcactgcttcctcccctggtagaaggggagctcttgtgtcttcaaccccttataatggtgttaatcccatatatgaggactccaccattatgattaaattacgtcccaaaagttgcacctcctaataacatcacattgggattgggtttcaaaatatgaattttgggagatgcaaacattcagtccatgacagacatttacatatgaaaatacaacatatctgagtgaaaacagacatatcttaaaaattgtattatgtaaattgctatcaagtatttataaagtggcattttgctttatattttattcaatgatgatgtgttaacaaggaaaacattgggtgagatagtgtaagagagcagatggtactcacttgtaatttagaatttgatgtaatgtgtcctttagacagttttatcagaatgtcttgtgattaagctaaaccaaatgttaatggcaaagagaggtctttgggatttcagtctagattatgtacattgatatcctatttcatataggtcaaacaatgtgctttattctcacatattttcatttacaatttacatgtcagtatattagagtgaagatcagtagagtagtggttactattcataagcgtgtctggttcattaggccaaaaatgccagctatgtttcagaataatagctttcttttaccattgattaacttggctctatgtgtgattgaaatataatttcattttttgtacttgtttagtatcaataaatgactatatttttcttaatgaagagcagtagagttatttggatggagactctgttaccattgttattctaaagattgacataaaactattattctttttcttattccaacatgtttagccattctcatgtcatttttataggttattttatttatctgatacttcaggtaaatttaattatttttagttagctatcaaatgtttagaactatactgtaatgattatatagaataatgctaatatttatatactatatgaaaacaaaaaattatgaatcagaacaaataacaataagaaagtatgtttctaatgaaaatgaagtggttgaaaaagtcataaaatgatttcaaatttacaaaaatgtatcttctgtaattttttaggatgaataaagataaaaattatatctgggtactttttatctgctactttacagtaagtgtaaaatgctctaatagaaattaacacctttggaatggaggtgatggcaatgtattttatgaaggaagtggcttataaataaatacttggtgagtgacatttaaagtctctaagtggttaaaaattgcttcaataaattttatctataggatagctataacttaattttaactcttaactttattgagtgaaaacaaatatttagctccattacatgagaaggcctgaggtatttatacctatagtcaaaacaaaacaaaaagattgaggtgggggctcaatgtttagcattaaatctttgtatttttttttcttataaagtagagccacaggaaaagctgagccaaaaattttaatatctatttttcatgagttaggttttatcataggtattgataatatgtgaattatctgaacctgggtatatgtaaggaaccaccatcaaagtttctatattgtctactttttttctttattggaaattaacttttaatctctcaatgccagattagttgaaatatgattacattatgtagatttggaaacaaaataaaacttttgcagattctttgaagcctcaatggaggaaatgtgacagatatatacagaagaaatctcaatcaaccagaaccattatttagtgtctgtggaagtaaaattagtttgagttgtgacagtcatttatctttttatattgtattgggttttgataaagcatctttttaccttttactacttttcatttctgcctcattcccaggggtctgcatgatacttttattaagactagaaccattttatgtcatcattaatggaaatgactttgtacatgactttattttttgaattggaaggctgttttcgaattcactggaaaaagttttcattagatggtgcctgtttaaaattatgtaatttgcacacttcattttttaataaacattcattccaattccaagaacaatagtttaacttgttaaaagaaaaacttgggacaaaataaatttagcagagcttatttgaacaaagattgattcatgaattgagcagcattctgaaccaagagcttcggacacctccagctatcaatgtgagcaggaagtatttttagacagaaaaaggaagtgacgtttaggaacatcttgattggctacaggtcaccatttgccctatttgggcatggtgtgatgaggcatttaccttgtatggaaatagtctgatcagttggcagcatgtgtttggctgaagctcagctgctgtgattagctgagactaagctatctgttgtaagaatacactcaaattatgttgcagtttgtttacatactatatcaggccaaatttaatttaatctccccttttggccagctgtcagttttgagaaattgaccaaaaaccttaggcactaatactactttctgtcactatcataatggacttgttttgtctgaatatggaattcacaatttgcaatgtcaagtcagttggatgatttttttatattctctttgtgtttttattattttaactatagtgagaccatctgatatataacagatggctgcatatgaacatataagacttgagaggggccgggcacagtggcatacacctgtaatcccagcactttgggaggccaaggcaggtggatcatgaggtcaggagatcgagaccatcctggctaacatggtgaaaccctgtctctactaaaaatacaaaaaattagccgggtgtggtggtgggcgcctgtattcccagctactcgggagggtgaggcaggacaatggcatgaacccgagaggtggagcttgcagtgagccgagatcgcaccactgcactccagcctgggcgacagagcaagactctgtctcaaaaaaaaaaaaaataataataataataaagactcttgagaagatatggcatactaaggagactattataataatgactatcatgagggtaatattaagagactgaactatacttcttaataggtgcttccatgaatcaaattggtcaaaatcaaatatatcaacaacaagccagaagaggaatctacttgttttaatcaattatcttgtttgttgatttcttaaaactgaatttctatcatgtcggacataattttccaagggcaataggaggtgtcatctgttgcacacactcttccctcttcagtcaacagataggccaaagcaaccatgttatctaaaacaactttagcaagagaatttaaagatgtttgatgggcaactgtagccaatttctgctatagtagctaatgtttgcgacagatttctaatcatagtctcatttacatttatgccaagccagggaaggagcattctaccaaaagatgcctgtttagggatacttagacttgcttgcaaactcctctttattctatagttaaattaagaggtgtagaccaatgttcaatttccaattggttattggaaataatcatgacaattctaacagtattactgttaaaatccctattcaacattttccacttattgagacatggagttgctcacatatatggttggttgttaaatcctatacagataaaaatataccctggtgaggcacgacagacagttccttgccttgtgtgttaggggccacagtagagaagcactagtaatatttctccaaggctccattatgaaatcattgcatggttgaaggatcttgacaattaaagggattagggtgataaatttctctacaaactgttgaattacctttcttttggttatcctattccatttctggcataatgtaactgcaaatccctcataggttttgactactgtcagatttaaacgaagaacctgatgtgtgaagctaaaagcctaaccctgtacaaaggaccagatattgctcttagaacatcagagaaatttgttagaaggtgaagcagagaatctctaagatcatttaaggatttgtgtttaacataacatatccaacattcagttacgttgcctgcaaaagctattgattatgaaatcataataagcatgttatcttcctgggtatatataaaaaataaaaacagagaaaagaggaaaaggaccatggtttcatggtgactaaggaaagaagtcttgatctgtcttcttgggaaagctttcatgtctaggatgtcatttgtttctgaggagaaaggtccctggtcaattttgccttgaggtttccagtgggtgtactgtcctgagactgggaagggtcctcttaaattgagaaatgtggatccaaggctcaggctcaaggccctgaagttttgctgcagagaagaacttcgtgtagtcccttacagctgacttcaagggcagtctttctctggtgtctcttttgaaaagacccagtctccggggtgtagaccatgaaaagtctggttgtcatcagttcgtgggggcttcttctatctggtgaaaatataccttggcaaaatgcattaaagccttgcaatatcaagtcatgtcagagtttataaaagcagtaaatacatgaggttctattattacgggcgtaggccttccagtaaccattttataaggggtcaatctatgttttccagtgggagtggatatgattgccattttaatttgtaatacctttgaacaaggcagtgtagttagctttgcctaatgccattgtgtttataataccttatttgaatattttgcagtttgtccattgaaacatatgcctctattgctgtgattggctgggactcaactatctgttacaagaatatgcttgtaagttaggttgcagtttgtttaatcctaaattaggttgtagttcaccacttgtagaggcagcttcaggccaaatttaatttaatttaataaactaatgaaataaataagggagagtctgattcagttgaattgtatttggagttagaaatgtttattttaaagttcaccagaggatttaaatatacactgaagtttaagaatcattgctgtacaaaggtgaaaaataacatgctcttttaattttgtagtctgtcaagaactacaccaaatgtcatgtgagaaatgagcagatttgtaacaaacttaccagctgtaaaagctgttcactaaacttgaattgccagtgggatcagagacagcaagaatgccaggctttaccaggtaaagatttcaaaatttagtaaatgagtttatggtctacagataaatactgacatagaaaagtacatttagtaaggacactacattttctaaaattaaagtcatagtaaatatcaacctataatattgtagtactaataacactgtttctacaagaaaagttttttgattacatatttgcttccaattattttaaggtgttcatatgtttatgatactgttgaactgattagataccttttcatcgaaaaaaatcttaaaaatgtagaaaataataagcactcagacttaatattcagatttaacaaatactaacattttgttatattttatttaagtgccttttattttccaaactcagtgcatattttcattatacattataacatttataaaaaatattttaaggcaacaataatatagaacatattaattatatattatatattttgcctctctgtatcctaaaatatatatattatatattttccctctccatatcccagggttttaaaaatattatatatataatatattaacaataaatacataaatatattacttatataatatgtaacatatatttattaaaattatatatctagtaattttaactaaatatataatttatatatttaataaatttaaaccataaatttatatatttattatattacatttataatatataatataatataaattatattttaatatattatcctatataatataattttataataaatacatttctttttttatttttttaaaattattattattatactttaagttttagggtacatgtgcacaatgtgcaggttagttacatatgtatacatgtgccatgctggtgtgctgcacccattaactcatcatttagcatcaggtatatctcccaatgctatccctcccccctctccccaccccacaacagtccccagagtgtgatgttccccttcctgtgtccatgtgttcacatttcttataataaatatgtgcttttatgagaatccgaattttataaactacagcaaagctcatttttaaaagtaatttcattttttcacagttaacattgctagtggatgctaagtactcttcctttgaaatataaaagataaaattagaaaattgaaaggtaatacaggcatttaaccagttctgcttgttatacagataaactgagatccatgctggttaagtgatatgctcaaaattatgtgacttgtaaatgacagagttgtagctattaactaggtgttttatttctgtttagtattttacctctctttatcccaggttttttttttttaaaggtggaattatttttttattattattatactttaagttctggggtacttgtgcagaatgtgcaggtttgttacataggtatacacatgccatggtggtttgctgcacccatcaacccatcacctacattaggtatttctcctcctaatgctatccctcccctagccccctacccccactttttttttaaagaaaagtttctgagcctatttaattctaaaacatattggaaaattccatcacagaatttgtctgaaagagaatctttcttacaagttaatgtgataaaaatcaaaattattctgcctttaaaaatgccattgcggtcaggtacggtgtctcacacctgtaattctagcactttgggaggctgaggtgggtggatcacttgaggtcaggagttgaagaccagcctggccatcatggtgaaaccccgtctctactaaaaatacaaaatttagctgggtgtggtggtgggcacctgtaatttcagctactcgggaggctgaggcaggagaatcacttgaactcaggaggtggaggttgcagtgagcagagatcacgccattgcaccccagcctgggtgacagagtgagactctgtctcaaaaacaaacgaacaaacaaacacaccattgaggcgctggaatgtcattcatactttgaattttgtttacatactggcccttaaagcctttaaacagtgcgatgtgcatgtgtgctcattttgagaaagatagtattaataatgcagtaggcagggtttaagaagcaacagtgagatgatactaagaagttgaaagtggtattggtctctcagaattaaactataaaatgaaaatgtagatcaatgaaaatatttacaaagtttcctgaaaatgacaaggttaatcttggaccaaaataagatttgaatgaaggaatgtatacatttcaaggaatattactttgataagaatggaaattagttgccagtggaagtttggaaaaatgatagtaaagttacttttggtagtactcatctactcattccctaggaaaaaaatgttgctttgttataaaggctccacttgaccaggctattattttggaaatgtaatgaaatatattatgcacaaattctcttttcttaattcatatttactaagcagccaactggttatatatcgtttgatttccattcagcttatctcaaggaagtgaatgctctaaatagagggcccagtctgtagagcagttgtacaattccatgacaattggtgtattgcattttttttacattgatctcatatgagcttggcaatttgaatttatctcactaaactcattataaattaattgccttccttttaaccccactgctaagttgttgcttaatactacaaaagcctgaagtataaaaatatttggtttggtagtataatttagtttagccacaaaggcccatgcatttgtttttatttgtatgatttgtcaatgaactatttttgttctcactaaaaaataaatgaggagacaggcaataataatctaaattcttccttgattcagtaaggtgagaaaaaaccgtaatttaagaaaacgtttgcattgtaaggaaaagttttttggtattttggatttaaaaggactgtgaaaattgaaacacatatagcttcaaactgaaaaccagggcatgctacacagtcttattaaatgataattatagtttattgagggattactatgttccaactgctgtgagattttcatggtacccaatttaatccttagagcagcaaccgtgaacgaacaggagtccccaagatgctttcgagtgggtccatttggtgaagactaatagtactgagacattatttgcttttaaaattttccatttgttatgggtttaccatggagttttataacggctatctgttgtatgctattccaatagactgaatgtagaagaaggtatgagaatatagctgtcaaatgccaaatattgaagacatttacaaaaatataaaacaataaaaataaaatatgctattaagttgtaatgttccccttcaacattttgttatgaaatattaaaacagaaatattaaaaaacagaaataattgtggagaggacacccaatacctacattctagattctgcaattaacatattgctctatctgcactatccctgatctctctgcctatccatcccctattcattcattaatccttctttattttttgatgctgaggtctaatttgaattgtcagctactttccctcgggaagggaatttgaggatacgtttcctttgggcctatttgtataccatagtggggcaagacatctcagcagctggaagagtgcatttatagtggggtttaaaattattattttaaatgaataaatacatgtatttgttaaagttaccatttttaattttaaaaccatttttaattttaaaacgctccaaatcagtagatatagcatgcataaagagaagttctgtgggaccctcaataatttttaagacttaaagaccaaaaatttgagaacagctgctttagaacaactttataagagttgcagcaatatatccaaggtccttcatacagggctagaggcgctaatacatttcatatgatatagaaactaaaatgtaatctaactttatagatcagtatatcaatgaaacactattattaattagtgcacactaaagtttagccttattaatatattatataaacctgtgttttggaaaacggtgtttcaagttcaatttggattctatagataaaccattattactgaacagtatgtttcatttttagaaagacatgaataattgtgtaaaaataaacattagcaaggaaagatcatagctactttactaatcataagtgaaatgagacttctctacccatgcttatgaaagaatcagagaacccaacttataccacaactatatacctgagctatagaaattagatttagaggtcaattagcttcacttataggagtaactttgaaactgcttctgttataagcttgttgtttttctattaaagtaatcttgtcttatgtaaactagaccttgggacataaatatagtagtgattttacttattgaaataccatatgccaatataccagatgttacacagaaaacctagcagtcaacacatttaacagatgtcatagagccataatttatctcatgtttaagatttaaagaaaaagttgggatgttctgctttcattctctaccaaactattagaaaaatttatttgaaatattgagatatttaatatgttttatttcaaaaataatttaaacaaatacagaagtactttgaaataattgaaaaatacatttgctttttggtaatctaacaataagacacattttttttcttactagctcatctttgtggagaaggatggagtcatattggggatgcttgtcttagagtcaattccagtagagaaaactatgacaatgcaaaactttattgctataatcttagtggaaatcttgcttcattaacaacctcaaaagaagtagaatttgttctggatgaaatacagaagtatacacaacaggtaacatttctacttgtttacattatggaaatatgctatgataatttcataattatttgaaatttttttttggttttaatacattattgttgctaattttggaaataaaagtgaaattgatttctcaagtgaattggcagaagacttattttgtataagtaataaggtaataaggttttgtaaattatcactttttgcagagtaaaccactgtattaccttaccaagaagtgatcttatatgaatagatacacttaaagagtatataatttaagaattataactgcacttggtatagtgtggcagaaacaatttttgctgaaaacttttcagagcaattatagtcgatcctctgtatctatggattctgcattcatggagtcaaccaaccgcagatgaaaaatatttttaaaaagtatggttgtgtctgtactgaacatgtacatactttttttcttcccattagtctctaaacaatacggcataacagctattcaataacatttacattgtattcagtaataatctagagatgattttaagtatatgggaggatatggataggttacttggaatactatgccattttatattacataaggggtatgatatttatggatgttagaatccacaagggacctccgtatcctccatggatacagagagatgactatgttaccaattacttgctatatagaaacaagtaatgcttacttgttacagcttactttaaagaagcattgtagatagcatatcaaaatggtggacagcataaaatctggacatatgcttatttctacaacttagtagcaagttaacatccctagctctatgtttctcatgtgtaaactggcataataatcatggctacttcatatgtttattgtgggtaataaatgagatactgcatgtaaagaatatagaaaaatttatttttgagagttaactttggttacaatttttactatttccattttaagggatactatttttttgtctttgttcccactactgctattactactatttccaggaatcattatttagacaatgaatttttaggtaactaaatgaatatttctggtaaatagttaatattgaaactgattgtggaaaaatgtcttaatttttctatggtaagtacatttttttgttcaagcttctattaaaatttattttattgtcactgaagaattgtatgtatttatggggtacatagtgctggtttaatacatataatgtatagtgagcaaatcagggaaattagcatatccattatgtcaaacatttattatcatttacttgtgttgggaacattcaatatcctccttctagccatttgaaactatgtgatatattattgttaacaatagtcatcctacattattatagaacattagaacttattcatcttatcgagctgtaattttcaatcctttaataaatctcttcttatccctccctttcgccttactcttcccagcctctagtacctctcctctacattttacttctataagatcaactgtttttttttttttttttttttttagcttccacttatgaatgagaacacagggtgtgtaactttctgggcctctcttattttacttaacaaaatgtcctccacttccatccatgttgccatgaatgacaggatttcattcttttttaatgactgaatattatccccttacttatatttaccacattttgtttatctatttttttcttgttggaaacccaggttggttccacatcttggctattgtgaatagtgctgcaataaacatgagaatgcaggtatcccattgatatactgattttctttcctttggataaatgtccagtagtgggattgctggaacaaatgatagttctatttgtagttttctgaggaacttctatattgttctccataggggctgtactaatttacattcccaccaacaacgtataagaattcccttttctctgcatcctcaccagtattttttgactttttgataatagacatctggaggtgagatgatagctcgttgtggtttttatttttgtttccctgatgattagtgatgttgaccatttttttcacacttttgttggtcacttgtatgtcttcttttttttttttttattttttttgagacagtctcgctcagttggccaggctggagtgcggtggcatgatctcggctcactgcaacctccgtatcctgggctcaagcaattcttccgcctcagcctcccgagtagctgggattacaggcgtgtgccaccacgcccagctaatttttgtatttttagtagagacagggtttcaccatgttggccaggctggtctcgaactcctgacctcaggtaatccgcccaccatggcctcccaaagtgctgggattacaggcatgagccaccgtgtccggcctgtatgtcttcttttgggagatgtctgttcagatcatttgttcttttctaattcagattgtggttcttttgctgttgaaattttttagttccttatatattctggatattaattccctatcaaatgaatagtttaccaatattttctcctattagtctgttttcatgctgctgataaagacatatccgagactggggagaaaaagaggtttaatggacttacagttccacatggctggggaggcctcagaatcatggcaaaaggcaagaaggagaaagtcacatgttacatggatggcagcggggaaagagagggagagcttgtgtaggggaattcctctttttaaaaccatcagatcttgtgagacttattcactatcatgagaacagcacaggaaagacctgcccccatgattcgattacttcccatcagatccctcccacaacacgtggtaattcaagatgagatatggatgggaacacagccaaaccatataatctccctttctgtaggttgtcttttcactgtgttgtttcctttgctgtgcagaagctttttatttttatttaataccatttgtttatttttgctttagtttcctgtgcttttgaggtcttgttcataaaatcttttagtaaacccattcctgaagttttttcatatgttttcttctagcagttttattgttttgggccttaaatttagttctttgatccatttttttgttgttgtttttgtatagggtaagaggtgggggtctagtttaattctaatgcatatagagatccagtgtttctagtactatttattgaagagattgtcctttcccctatgcatgttcttggtgtaattgtcaaaaatcagctggctgcagctatgtgaattatttgtgggttctctattctcttcaactggtgtatgtttatgtttttataccagtaccatgctgttttgtttactacaactttgtagtgtattttgaagcctggtagtttgatagctctagctttgttcattttgctcaggattgctttggctattagggctcttttttgttccatacaggttttaggattgcttttcctatttctgtgaacaatgtcattggtattttataggtagtgcattgagtctgtagattgctttgagtagcatggttgttttaacaatattaagtcttctgatccatttgcatggaatgtcattccatttgtttggatactcttcaatttctttaatcagtgttttgtagttttttttttttgtagaggtcttttaccttcttggttaaattaattctaagtattgtaaatggtgttaccttcttgatttattttccacctagtttgttgtttgtgtatagaagtgctaccgacttttgtgtgttgattttgtaacctgaaactttgctgaattagtttatcagtactaagagttttctggtagagttgaagtggtgtcattcctctagggtaatacccgaggttctttgcctcacaccaaggaaatcaaggacacagacacacaaggagtgaaattaagagcagaggttgccaggcatggtggctcatgcctgtaattccagcactttgggaggctgaggcgaatggatcacctgagatcaggagcttgagaccagcctggccaacaaggtgaaacgccgtctctactaaaaatataaaaaattagctgggcctggtggcgggcgcctgtaatcccagccacttccgaggctgaggcgggagaattgcttgaatctgggaggcggaggttgcagtgagctgaggtcgtgccattgcaccccagcctgggtgacaagagtgaaactgcagccccccacccccgtccaaaaaagagcagaggtttaataggtgaaagaaagagaaaacctttctctcctgcagagagagaggggctctggagtgggtcttctagttctgtggtgaaatgcatggggttttatagacaagcttaaggaggtggtgtctgatttacatagagcccaaaagattgatctgaccaggtgtgtcatttacatagtgaagaagctggctgccctaccttaatcttttattatgtagatgggttctctacttggctagtgccatgttgcctgttcctttactgtacacgtggttgacaaagaaaagggaagatgtagcctccacgttgaacatgcctggcccccaggtagccttcacctagtggcacagctgccggcattcaccggtgtaagcttccagctttcttatctctgtctgcagctcaatttcacaggctgctctttgttagaaaaataatgattttggagctgctttttgttaaaagggaagtcttgctcaggactctcttaccctcactatctacctaaataatttctttctagttcttgtataagagtcttaaggtttttctctgtatcatgtcatctacaaacagggacactttgacttcttctgtttcaatttggatgtcttttatttcttctgttgcctaattgccctggccatggacttacagtgctgtgttaaataattgtggtgagaatgggtatccttgtcttgttccaattcttagaagaaaggcttttagcttttcctgttcagtatgatgttagctgtgggtttgtcacatatggcctttattattttcaggtacattccttcctaaataaaggtatttatttatttatttccttcctaaattaggtaattcctatgtaaatacctaatttaagtttttatcttgatgagatgttgaattctgttgaatgcttttgctgcatctattgagatgattgtatggtttttgtccttctatcgatgtgatatttgatgtttattaatttatgtaggttgaaccatccttgtagcccttggataaatccttcttggtcatggtgtgtattgttctgatattgttggattcattttgctagtattttgttgagcattgttgcatatgttcatcatagatattggcctctaggttttttttttttttttttttaatgtccttgtctggttttggtatcagtgttatgctgacctcatagaatgagttaagaaaatcccctctccttcagttctttgaaataatttgagaagaattggttttaattatttttgaaaggtttggtagaattcagcagtgaagccatctggtcctggacttttctttgttgtgagacttttcatcattcattcaaaatcatgaattttgttggtattttcaacttttctatttctttttggttcaatttctaggtttcatgtgtacagaaatttattcatttcctgtaagttttcaatttcttggaatatagttgtttatagtagtctctaatgaccctttatgtttctgtgttattttaatgtctcctgaattttcacttctgattttatttatctgggtcctctctctttcttgtttggtctagcaaatggtttatcagttttctttattttttgaacaagaccaacattttgtgtcattgatcttctgtattattttagtcctgatttcatttcaataaagatcatgattgccatgatctttatttttttccttcttctaattttggattttttttttcttactttgctaattctttgtgatgcaacattagggtgtttatttgaaatcattctgtttgttttttttgatgtagatgtttattactataaacttccctttcagtactccttttgctatatcctataggctttggtatgttgtgtttctgttttcagcagtctcaagtaatttttaaatttcattcttaatttctttcttcacccagtgttgaggactatattgtttaatttccatttattcacattgttttgaatgttcctctttttactaatgtctagttttattccattgtggtcatgtaagatagttggtatgattttgatttttaaaaatttgttgatatttgctttgtgtcctaccatatatggtcattcctggagaatgttccacatgctgatgaaaagtatgtgtattcttcagtacagtgttctgtaaatgtctgttagatccatttggtttatgctgcagtttaaatctgatgtttctttgctgattttctgtctagatcatctgtccaatgctgagagcatggtgttgaagtctccaagtattattgttttggggcatatttctctttttatatctaataatattttccttatgtatctaagtgctccaacattgggtgcatgtatatttacaatttatagtctcttactgaattaatccctttcttattgtataatatgcttctttatctcttttacagcttttgagttaaagtctgctttgtctgatataagtgtagctactcctgttcacttttgctttctgtttgcatggaatatcttttttcatcccttcacttttagtctatatatgtctttccaggtgaggtaagtttctcttaggcagcatattgttagttatttttttaaaaaataccctcagacagtctatatctcttaagtaagggaattcatttactttcaaggttattattggaaggtgagaattattcctatcaatttattggttgttttctggttttcatacatcttttcttcctttgtatatcctttctatcctttgttcctttcttcctctcttattatttatttttgtagttacatggctttttgtagtgatatggttttatttctttctctttctccttagtgtgttggctctaccagtgagttttataattttgtatatgttcattatgttggttatcatcttttctgttctagatgttaggctcctttgagcatttattgtaaggctagtctattggtgattaatttcattagattttgtctgtggaagatattatttctccttaatttctgaaggatagcttttctgggtataatatttgtggttgacagttttttgttttcttctcaatagtttgaatatatcattccattcctcttggcctttatggtttctgctaagaaattcactattgctgaaatggggattttcctatatctgactttatgcttttctgttgctgcttttagaattctttctgtttgattgttgatgatttgagtattgtgtgcattgtagaggacctgtataggctggatctatttggtgttctctaagcttcttcgacctgcatgtccatttctttctgaagacttgggaagttttcaagtgatttattaaatatttctagacacctgttcccttctgttctcttttgtagttcctataatacaaataggttttcactaaatgtttcttgtaaatgctgtaggccttcctcactccatattctattttatttttgttacctgtgttatttgcttttaagtccagtgattcttctagctgggcatggtggtgtgaacctgtagtcctagctacttgggacactgaagtaggaggatcacttgtaagcccaggagatcgaggctagcctaggcaacatagcaagatcccatctctgttaaaaaagaagaaagagtaattattttttctgcttagtcaagtctgtggttgaagctctctgttgcatttttaaagttttattcattgaattcttcagatctaggatttattttgttctttttttctgatatctctgttgttgaatttttcttccaaattatgaattgtttttcttattttgttgaattgtctatctgtattctcctatatctcactgaagttccttaagattattttgaattttctttctgatatttcatatgtttacttatgttgggttctattagtggagaaatattgttttcctttggggatatcatgttttctttgctttttcatgtttgatgtattcctacataaaattcttccaattttatggagtaggttttgtatggaaagaattattagtatgaatgggtcttggggtattagttcaatggggtgtattggtattggttctaggtagatgaagtagtgtagtctccatgtagtttcttcagctataatccacattagtgacatagtagtgacattttcaagtgtcttggtagcctttgcaaagagagtttgtagcagtggtgatgtggctttgttggagagtgtgctcaccttgctgtttctcagattacgggcatgtgagtacacacagtgggtagggcaacttgcattctggcttgctggggttgaggtcataggactgtcactcttggagcataggcatgcagtcacttggctgacctgggggcttgcctgtcaggaacaacctatgagattggttttcaagcttaagatgtgagtgtatagctgctcagttggcctggaaagattttttccagggttggcctttggggctgtttttcaggcccaggagacaagttgaaggctgcttggctgtcctgggggcttgcttgccaggaacaacccacagggctatttcttaatcccaggatgcaggtgcattgctgctcggctggcttgggggaatatctgctgggagtgcctcatggggtcgtgtctcaggcccaggatatgcttatatggctttctggcgagcctgtgggtgtgcctgccaggggtggcctgtagaggtgtttctcaggtgctggatgtggactcatggctgcttgtattgcctggaggcatgcccaacagtggcagcctgtggaactgtttctaggccctgattgccagtgcaaggcttttaggcaggccaagggcctgcctggagaggttgcaatgtggctgtttctcaggccctgagtgcaggcatgtagccgctcctctggcctaggggcgtattagctgcacagagtctcaagggcctctcctgcttgggggagggcatgcaatggtttgactggcttggctggctcaaggaccacattgtcctgtgtgggactgccagaacattcctttggctcagaagtgcagtggtggggattggtttccctgctgtgtaggaccagagtcacagccaatcctggacctaggctccattcagctggggttgtggcattcagccgcctgtgtgggcttggtggaacgaaaatgaactgcagtactggagagatgcagaggctactggacacttgagcaaggtacactccagaggtggctctggtctcaacatggcaccatgctgcagcatcttggctcaagggcttgagtagggaatgagaagtgcacaccttgtattcttaattgagggcaatgcagctgagggaattcctggcagcttctaaactgggctcagagcttgtaaggactgtgggattcttctgtagtaaggattataggtgtttttggtagcaatgggggctggtggggatcttctccttacctattccctataacacgaagtcactgctgatcctaaacagatccaatccaggtggagaagacagggcaaaggctgggtgcctccatgctgcctttctggacttccattcaccacaggtgcatctccactcccccactgcactccagcactctcccttcgacactccagtcaaagcatagctctttattcattgtctcaatcctctcttgtggtagggatgagcaccaggtgtctctagtcagacatcttgctgacatcactgctgaaatttttgtatggacactcagtccactgttactgccaaccctaatttttgtgatgaaatatattaatattagcatgtatatttctcatgagtatcaataatggataatctaatttctatccccagtttctgtctatacagccaaagccctcttccccattaataaaactgatgaattaattatatcctttggcttttataaatattaaaatattttgaagtggatattgcaatatggtacttcttggccttaagttttttttttacgtctgggattaatagggtaaagaaaaactatactaatcatatttatatgaacagttgattcaggaaactacttttctgtgaactgtagctatttttctgtgaaggatagagcagtagttattcatttggtatacatttattactttcagtgtacttggcaatctactgctttctgagattacagagatcaaaagacaattgctgttctcaaagagcttagtggggagagaaacaaacacaattctactgaaatgtgataattgcaatgatagatgcacacagggtgctatatgaagataaagggtaggcatctaacgagtaatgtggacctaagaataatttcctagaggagtgccctagctatgtcttacaggatttggagttggccagcacatgaaaatattggtaaagaggccagagaaatgcctaagtcttttctcttgtcttgagagctactagcttaatggctagaggataagatatatgaggtagcatgtaggagagacctatcagttttataatatttttgaagaatgtgacaaggtgtatttgtaaagtattatttttagcatatgggacaaacaacataagttaaaatctgtttatattcttgtgatgccaggagctttatttcttttactacaaaaaataagggacaattaccgtccgggcgtggtggctgacgcctgtaatcccagcactttgggaggctgaggcaggccgatcacaaggtcaggagttcgagaccatcccggctaacacaatgaaaccccgtgtctactaaaaaaaatacaaaaaaattagctgggcgtggtggtgggtgcctgtagtcccagctactcaggaggccgaggcaggagaatggcgtgaacccaggaggtggaacttgcagtgagccaagatcgagattgcgccactgcactccagtctgggcgacagagtaagactccgtcttaaaaaaaaaaaaaaaaaaaagggacaattaccaatgaacatgtgaaaattagttctcactaccacttatgcagagcttattattggcagattcaaattccctgatatttagaaagtactgatatttgatattagaactctgttgttttctttcttgcttaagacatattatttttagttcttacaatataaccttgaaatgtgcttttttgagattgcatatttcaagattgttatgttagtgttcactttttcttccctattataaataataatgattgaactaataattattttgaatgtgtgatgaacttagacttgataagttcatcacacattcaaaagttccatttgctaaggaatgtgatgctaactagcatgccctgtaaatgaagaatgttttggtttatcagaaagctgaacttcagcaagatttcaaaggtggagacttctgcaaggtgacattcaattatgcatatctttatataaaatgaattctgagtcattacagttgtataaactgaagataacccttttttggcaaataaagattgacaaattcatgcactttatagagatatcttgggtcaaatgatcatttacttatcagaaatggctaatgaaatgttacagtgatttatggtgtgctgcagtaaattttcataatatagttatttatcttacataagataatgaactgcctgtccagttcatttactgagtaatagttactttaaatgttttatcagcagctccatttttctgttttcctcctcttcctctcagatttttatcacgatgagttagggagtaatatttcattttaaatgacttgtcttgactatagatagttcagggatataggcagaattgctgtcatgtgaaacacagttgttaatctgaaatatctatgttgaattgactcctgctgttattatcaagagctataagaatgttttaggtttttgcttattaaaatatttttcagaataatatatgaaatatatgctggtcacaatgtgaagcagcatgtgtgtttttataattagaagcattatttattaagtaccatctttgttttaggcactgtgctgatgatggaagataacaatttttattctaatgaattttgtttagcaaaatttactgattacctactatatgtacagtacttgggcaatatcagatctattgtcataacaagaatttataagatatttaaattttatccaagaaacatttgttgagtgtttactatgtgaaatttattgtatttgtactctgcacacatttctaggtgtggctatcttttaagatctctaggactatatgcacatcataattagaataaatactggatataaatatcttatttctatgttgttaatgtctaaggtggagaaacatttttctctatcctggtactccataatgtttaaaaaaaaagaacaatgtggagttttgacatcatttcacattgtaatataatattggtagcttagtattttggaaaataaatctattatcatatatattaaaatagagatgtttataatataaaaaattgtaaagattagtaacttggatcatgaatatatcatttttaatataagaacattttaaaattgagtaattattaaggttataaatatggtaaagatttttatttcaagttaattttgaaatattacagcattaagaatagttatgtagtatttgtcaatcttagttaaattataggcacgagcatcagattttattacttttgttgttttttgttaataaaattatatgacataaatttatccaaaaatcatatagaagtccagatttatttgtagacgtctgagctaagagagaggcagttattcttctgtaagtctttttgctaggtcttgttatgaagtcttcactcagactctatatattgtttgttgattttattttctagtttcacaatgcagataatggcaatttatctttagagtcttaatcctataactgattacattgatagtagtaatagtaatagaagcagcagcagcaataacaatatgttaagtttttaaataatcctaccttatcagatagataattatatctccactttatagaagagtaaactgaggttcatgaaggctaaataaattattccaatcatgtagctaaatataaaacctgtgttttaaaaacagtgttctattctacatcattctccaaaatatgctataattgttaattattcttagtactaaaactcattagaaaggcagctttatatattttcaaatataatttttaatgatagtgaactatttgctaaggaatatgccatatttttacatctaactttctttgaatgccccttttcctgttgtttacagaaagtatcaccttgggtaggcttgcgcaagatcaatatatcctattggggatgggaagacatgtctccttttacaaacacaacactacagtggcttcctggcgaacccaatgattctgggttttgtgcatatctggaaagggctgcagtggcaggcttaaaagctaatccttgtacatctatggcaaatggccttgtctgtgaaaaacctgttggtaagtagtccagtaaattagcattcctttaaaagtatgtttcccacccatcttctcattccttccttctagggtgtagtcttattctatgatatttatgtaaattttatttttatacacattcttccccacttactattagtgatctcagcattaacttgtgaaaataacataatattattattttatgcaaactttgttggttcaaatagtgagattgtggttgtagttacttataatatgacaataatctattcttaattcattaatgtcttttacttttatcatgatagtgtttgggaagaagatttgcttttaagattaatggctaattgggactccttttactcttgtagacatatttcagttatcaagtaaaaagaaacatttttgttacatcttctgaaatggatttttgttaagtaagaaaggaatattgaattcttttcttttaaatcttatatttttatcatggtaaaatgtacttaaaatttaccattttaaccattgtaaatgtattttaatgccaattcaatggcattaaatactttgacactgttgtgcaaacatcatcaccatttagctccagaactttttcattttgcaaaactaaaaatctgtacccattaaacaataactctccatttcctccaccccaccccctacagtccctagcaactactgttctactttctgtctctatgaatttactacttcaggtacctcatatggtgaaatcatacagtatatgtgctttgtgactggcttattcccttagcataatgtctttagggtttaaccaagttgtaggatatatgagaatttccttcctttttaaggttgaccaatattacattatatgtaaatactacattttgttcatccattcatttatcaatggatacttgcgttgcttctacctttttgctattgtgagtaatgctgctatgaatgtgggtgtatgaataactgttcagcttcttgctttcacttctttggggtatatatatatagccagaagcagaattacaaaataatgtggcaattctgtttttcacattcccaccagcagtgcacaaaggtttcaatttctctccatccttgccaatatttatttcctattatttttaaataatggccatcttaaaggctgtgataaatattgtatcttgtgtaatattttatgataagctgtatttttattctttgtttatatcaaagacatgttcacttacaggacatttactttgtaagatgtggaatgctatggaaaacgtggctgggaaaaaattgtggctgggaaaataaacagtgctggtatacaaactaggtcatagattacattactgcttataatacttaaaattatacaactttatatactttgtaaagaattacaaatttcaaaggagttatacattttcaaatttaataaaaattttaagaagtattgatatatcatctttgtttttatctacctcatcatattataatgccacagttggcttaattgaaacatgccctgaacagcaaagcaaagaaaacccatacaattgtgttaacatgaagttaaaaatgaaattattgtatttgtttatttattccagttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccgtaagtatttatctagagtgacttttcacttgacagcaacgtaaatttacttttctgtgatgtaaagaagaattaaatatttgaagaagtttcaaaaaatgagaaaaaatattgttacggctacttttgaaaccaactggtactgttaacctctgatttttattatatcatcattttgcatgccactaagtatcttaccctaaatattaacatattgccacatatgtacagcctcttttccctgaactgtgtgtatgttgcagacagtataacacttcatgagagtgttcacctcaaacatcacagattgctttggtgagcctttttagtatcttttaatctagtgcaattcccatatcttttccttatatgactttgatatttttgaataacctataccaattgttttggaggtttctcaatttggatttgtctaatttttccctcatgattagattcaggaaagcattttggggcaagaatattttatcaatgttggtatatctgctacaagtatagaatgcacagtcttgaaatcacatagagttatgtcagcagggcagtactgggcttgctatgagttatacttcaggagaaagattttgccccttgctgatctctcatgttttctaaggactataggataaggctgcacctgaatgaatatttaatactgggtactatgtggtgagagtggccttgcttacaaacacaaatggcgtcagaatacagctgccaagggaattgcataatgctactgggagcacttgttagccttgtaggaacttaagaccgtgtgaaactctttctgcttgggagaaaaaagtgccaatcttagctagcttcttcatagcagagaatatggtttatctttctgcaatccactctttgacactgacgctcatcaaaaatatgccttttcacctgaattaattggtatgttcagatttggaacaaaaaagtagaaagttttacttactcctgctgctctcatgacctgtttctcaatgttggttgcattcattcatatcccactcattggtatctgtccctcttgtaattaatccagactttatgtccttttttttttgaataatatacttttcaggggcccagtagttaccattctaccaccatagaaagctgcagaatcacctgagataaagttggtatgcaggtttttttttttttttttttttgagatggagtctcactctgtggcccaggctggagtgcagtggcctaatttcagctcactgcaacctccacctccctggttcaagtgattctcttgccttagcctcccaagtagctgggactacaggcatgtgccaccatgcccagctaatttttgtactttttttagagatggggtttcactgttggccaggctgatctcgaactcctgacctcatgatccacccagctcggcctcccaaagttctgggattacaagcgtgagccaccgcgcccggccggtatccaagtttatgtccgttgaggatgctttgatttgaacaaagcaaaatatcagttatttggtaaagtccaaacagacaaataaaatcagaagttcttttgcttctttttcagttcccttcttctcaacatctgagtgtccaggaagctcacaaagaaaaaaggagcaagactccttggatttttttttcttccaatactttaacctgcagtaaacaggatttgaaatgagtgaatctaattaacatgttggtgtgtttgatccaggttccaaagaaactgtagttacagttcagtcaaaggagacaaaataacagccacttggagtctggtgtatctattaaactcaggaatatgttgtggttgaaatgtattcaatgagatagggaaagcaacagtttccctctctatacaggaattctctccaggggatctttatcccgattctaattcctttctcctaacagccctaagttctccactatcatcatctctcttcatttgtcatatttgaaacttttaaaggtcaaaggtccattttaggtttttgcatcagtccactggtttccctctgaccctttctctccaggaaacagccacttggagttttcctaggagtgtaggccataacacagcttgtttctataacgttcataagtatcttcaggactttcttattagatcattgactttcttgcagtccctccataggagcagccactggcagcctgactgatgaaaatacaaacaactatcccagcagcaatatttattttctgcccgtccactcttccttccctcctttgagctttcttgtttttcctctgagaggcaacccattctagttagcaattatagtaatgatatggctcccatgagtggaggaacaccagggctcttgtctcacgttgaattagattaaacaatacggacacacgtggagtggttttaaggagcagagagtttaataggcaagaaagaaaagaaaaggcagaaggttcgctcttacagagacagagggatgggggctccacagccgaaagaggaaaccccaagtgtggtgcgtaccaggcaggtatatgtagaggctggaggagggggtgtctgatttgcatagagcttaggggattggtttgaccaggctttcattcaggtagccctcggaaaaaaactggccttcccaccctagccttttaatatgcaaatgcagggcaccatgatgttctacacacatggggatatgtggggcggccatattcccaaatacatgtggggcaagggcaagaggacaaaggtgggaatcgccatgttgagtggacccagtttctaatggcttgcatatgcatactaaaggttgccggcttggctctaagagctgggacttttctgttagacaagaaacacttttggaggtgttttaaaaagaaatgaaaactttccaaggactccttttttctctatctgcctaaaataatttcttaataacttctatcacagtaacttcataattctgagatccctgttggtggtaaatctagtatgttgaagcctgtaagtgtatggcccttggacaacatggtcacccagttgatactagtccttcttgctcagatgagtcatcttcccatttagaggtagccactgcataaggcaatgcacgtagagacttactgactttctaggcctttcatcactctcagtggtccagtcaaatatgtatttggtccatagtgggcaccactgttacttgaagagctaaggcaaaacagtaacacaatgcaggctggaatcccagctgcagctgttgtgttcatttgttccttcaggctcttggcatgaagtggagaggtatgcctgggatggacatggttggatgtattatgagttgagctccctgttgatatccttttttagggattgtggtaaggaatgggggtgttgtacctgatcaagtgggtggcagtgtggtggttgcaggcataaaatggcctttgtgcatagcaaaacatttcaaaactaggagccagctgcccaggagagttgaatacaagagttgaagacttgtggggaatgagacaatgcgcaccttctcctgcctcaatagtcatgcttgtctctcgacaaacattattgttcaatgaaagaagctagacatgaaagattacatactgtttgactacatttaggtataaagttaaaaaatagtcaaaacggcactgtattgtttagaaatgcgtatttaggtggtaaaactatagagtaaggcaaaagtgtattctcaaaaatgtcagctagaggatgttgctgggggaagtttaggggtgctgattaggaaatgaaacaagagaggcaatgctccacttctaggctttgtgcaggtccagagtgtgtgtttataggaatttattaatcttatatttttctttatgtaattgtatgtgtgttatatttcacaataaaagaggctagaaagtagggaaaaactggtttgtgaaagtctaagctcttatactcttaacaactttctaaaaattatttagaattaagcttatgttgtcacaaatttttcttatatcccattccttctcatttgttctacttttttgtttttttacaattttttttggtggtataacacacataacataaattttaccattttaaccattggtaaataatctttagtaatttctttcaaataaattgtgacataaacttttgagtctttgcatgtctaaaagtgtacttttcattttcacttgaatgataaaatggctaaatgtggtattccaaataattttttccttggaacctctttagcactcagtgttgtggataagaattccaatgccaatctaattttcattcctttgtggaacatcttttttatcccccctttgggagcttttaagatttttttctttcttgttggcattctaaaatttttcattgttttaattcagtttttcagtgattgatgtggatctttaaaattaatttttttttacagtttttcattgaagaaaaggatttttagattttttagattttctcattggctctttaaatctgaagagtagtttgtttcttcatctgctaaaaatgttgtgtaatgtcttaaaatacatgttttcttctctttactcttgttgcaaatattaaaatagttgctggaacttctagatatatcttaatatttcttaactctgtttgcattttttgtatttttgtttgctaatatttagctatttttctttttataatcctttgagactttttatttatttgaaataagttttttgagaacaatataattatacagtgcaaatataaaaattgttgtaactgattttttttgagaaggttaatgaaacataattcactattttaacacaggtatgaattaaattctaccactgacaaatcaaataatgataactaaataccgctggtgggattgtcagctaggcaagcataagtcaggtcttcaggtctgccattgtctctcttgtttttgatcttttgcttcttttgttttcttgattattatagaggcttcattgtctacttctaccatttgttccttgagcagatagtctagtttgctattttttctcctctatagttcctttctctgttctgttgtcatgttcgcctttcctgaagctgtgtatagatcatttgtgctgataatgtccaatactactctaacagttatttctatttcacagggtttttttgttggtttttgtttttttgagacagagtctcgctctgtcacccaggctggagtgcagtggcacaatcttggcccagtgcaatctccgccttctgggttgaagcaattctcctgctgcagcctcctgagtagctgggactacaggtgcctgccccatgcctggctgatttttgtgtttttagtagagacggggtttcaccatgttggccaggctggtcttgaactcctgacttcaagtaatctgcccaccttggcctcccaacatgctgggattacaggtgtgagctactgcgcccggcctccacaggttttttattatacaccctgtgtgtcgttgtggggaagaagggcattgaacattgcctcaaggagactttgtatttctgaaagaagtagttacctggcagtgatccactgtttgtgaataatgaactccttcattatgtttaatttttcccgtgtttttaaccaacagacatttgtagagtagtgaagaaatgccaggaagtacaatagggactaggagtaaaatgacattcttgttcaaaatacaagttaaaagtagctgagtgttactctttcataggtgtcagcttcttggcaatggttttagtgtgcttttgactttaactttatgacttttcaggataaattatatatatttacattatcgttttctactacacgtctattcatttaacatttgagtctttaaaatatttttatacttatcaacaaaactttgtattggaagtggtcttttagttgccttcagaaagttgcctcaatgttcatttgaggtttactggtaaatagaaattaaggcaaacttttctttggaaatgagaaacaaataggattttgcaatattctccagtatttttcagtcataatattgtgatatcattgtttaaaattcacgaattgaagagaggaaatgttttttaagataatttttgactaatggtttctgagaaagctttgctaataattggcattattagtaattgatatattttgggtagacagatattctacttgtgaaaatgaattccagggcaatgtttaaagaaaaataggagatttagtcccaaatgtataaaggttcaaatgaaaattcaattaaatttgtatagtaaaaatagaataatacacaacttgaggataaggtgttatctcacaaatctgtatttttttcagtatttgtaagtttatgtgttcaatttaaacacttcaacaattaaggaaggtaatcatttttaaaatttgatgacaatttcttacagattgattttttaatattcttacccatttgaaaaaccattttgaatattttacaacttgatcttttgaaaagccaaaaataaataaacaggattgctccaattaaccatatttcatacaagtccttatactacacataactttaggaacaatagcatagcctgcataaggtttctcatatattatctattttgctgtgtagaagcttttgagtttaattaggttccttttatgtatttttgtttttgttgcatttgattttggggtcttagtcataaattgcttatgccaatgtccagaagagttttcctgaggtttcttccagaatttttatggtttcaggtgttagatttaaatctttaatccatcttgagttgatttttgtatatggtgagagacatagattcagtttcattcttctacatatgttgatccagctatcccagcaccatttattgaatagggtgtcctttcctcaatttatgtttctgtataatttgccaaaaaatcagttggttgtaagtatttggctttatatctgggttctctattctgttccatttttctgtgtatccccatttttctatgtatctacttttatacaaatactatgatgttttgattactatagtcttatagtataatttgaagttgggtaatatgatgcctccagatttgttatttttacttaggattggtttggctatttaggctcttttttggttctatatgaattttaggattattttttctaattctgtgagaagtgatgttggtgatttgactggaagtgcactgaacctgcagattgttttgggcagtatgattattctcatgatatcagttcttctaacccctgagtgtgggatgtgtttccatttgtttttgtcatctatgatttctttcagcagtgttttgtagttctccttgtagggatagtttacctgcttggttaagtatattcctaggtattttatttttgcagctgttgtaaaaggggttgagttcttgatttgattctcaggttggtcatttttggtgtatagcagtgctactgatcagtgtacattgtttttgtaaccttagactttactgaattgatttatcaaatctaggagtcttttggagggctctttagggttttctaggtatacaatcatatcaaagtctttagggttttctaggtatacagtataaaatcacttcatagtctttagggttttctaggtatacaatcatatcattggcaaaaaagggtagtttgacttccttgtttcctatttggatgccctttatttctttctcttgcctgattgatctgggtaggatttccagtactatattaaatagaagtgacgaaagtgggcctacctgtcttcttctagtacttagaggtaatgcgttcaacatttccccattcactgttatgtttgctgtgggtttgtcatatatggcttttattattttgtggtatgttccttctctgcctagtttgttgagggtttttaattataaagatatgctggattttaatgaatgcttttcctgtaattatttgagattatcatatcacttttgtttttaattcattttatatgatgaatcatatttattgacttgcatatgttgaaccatccctgggatgaaacctacttgatcatgatgaattatctttttgatgtgccactggattcagcttgctagtattttgttgaggattttttcatttatgttcatcagggatattagtctgtagttttcttatgttcttccctgactttgctgtcagtgtgatactggcttcatagaatgagttaggaaaaatttcctatttctcagtcttttgcaacagtttcagtaggattggtaccaattctttgaatatctagtataattcggctgtgaatcccctggcccttgactttttttggctggcaaattggtattactgattcagtcccgctgcttgttattgatctgttcaggattttgatttcttcctaatttaagctaggagagttgtgtgtttccaggaatttttccatttccactagattttctagtttgtatgcatagaagggttcagagttgtctcaaatgatcttttgtatttctgtgatgttgtttgtaatgtctccattttcatttctaattaaacttatttgaatcctcttctttgttaatctagctaatggtctatcaattttatcttttcaaaaagactagttttcatttcattggtcttttgtattttgttgctttcaattttatttagttctactctgagatttgttattttattctgctggctttggatttggtttgttcttgtttctctagttctttgagatgtgacattaggttgtcagtgtgtgatctttcagactttttgatgcaggcatttagtactataaacttttagcaccacttttgctatattcaaggtttagataacttatgtcacagttattgttctttttgcagaatttaaaactttccatcttgatttaattgttaaccccaaaatcgttcaggagcagattgttaaattttcatgtatttacatagttttgaaggttccttttggaattgatttctagtttcattctactgtggtctgagaagatacttgatatgatttagattttttttttttttttttgagacagagtctccctctgtggcccaggctggagtgccgtggcacaatcttggttcactgcaacctccacctcccggattcaagcaattctcctgcctcagcctcccaagtagctgggattacaggcacatgccagcatacctggctgctttttgtatttttagtagaaaccggtttcaccatgttggtcaggctggtctcaaactcctgacctcatgatccacccaccttgtcctcccaaagtgctgggattacaggcgtgagccactgcgcccagccgattttgattttttataacttattgagacttgttttgtggcctgtcatatggtctatcttggaaaatattccatgtgctgatgagaagaatgcatattctgcagttcttgggtagaatgttctgttaatatctgttaagtccatttgttctagagtgtaatttaagtccagtgtttctttgatgactttctgctttgatgatctgtctagtggagtgttgaagtcctccaccattattgtgctgctgtctatctctttcttaggtctagtattgattgttttatgaatttggcagctctagtgttaggtgcatatatattttagattgtaatatcttcttgttgcattgatacttttatcattatataatgaacttcttttttttttctttactgttgttcctttaaagtctgttttctctgatacaagaatacctactcctgcttgcttttggtttccattggcattgaatatctttttccacccctttaccttgagtctataagaatctttaaatgttagatgtgtctcttgaagatagcagatatttgctttgtggtttttcatccattctaccagtctatgtcttttatgtggagcatttataccatttacatgtaacattaattttgagatgtggggtacatttctagtcatcatgttgattgttactagttactttgttttcttcattgtattattactttataggccctgtgagttttatactttcaagaggttctattctggtacatattgacctttcattttaagatttagaactctttttagcttttcttgtagggctggtctggtagtgacaaaatccttagcatttgcttgtctgaaaaggactttatttctccttcatttatgaaagttagttttgctggatacaaaattattggctggcagttattctgcttaaggagggtaaagagagaaccttgatcccttctggcctgtaaggtttctgctgagaagtctgctattagtctgataagtttttctttatagattatctgatacttttgtcttagtgctcttagaattcttttattcatgttgacttcagagagaatgatgactatatacattggtaatgttgtttgtgcaatgaatctctcaggagctctttgagcttcttgtatttgggtgtctacatttctagcaaggccaggggtgtttttctcaagttattccctcaaataagtttttcagatgtttttctctttcttttacctcaggaacaccagtgattgttaggtttggctgttttacctaatctcatatttcttggagactttgttccttttttaaattattttttctttatttttgtttgattggtataattcaaaagctttgtctatgaggtctgaaattatttcttctactttgtcttagagtagtatttgtctaagacaaagtattgttaaaactatccacttgcattttgcaattttctaaatgtgcctttcatttccagaagttggtttctttttttaaaatgtattattttgttaaaatttttatttatatcctgaattgtttttttacattttcttatgttggttttcacttttctcttttatctccttgagtaacatagtagtcaaccttctgaattctttatctggcatttcaaggatttcatcttggtttggatctattgctgaagagctagtgtgatctttttggcagtattataaaaccctattttttcatattgccagaattatttttctggttccttcttatttctgtaggttcttataattatttttgaatttatttttgattcaactgtgcttttttcatttcttttttccccttgagaatgtgactttaatgtttgtagtttattttaatctaatttggctcttggtgctttcagtcatgaaggctctgtatgagttccttggtcatagagagccttttcatggtggctttctcagatactggttgtagtagtgatgtgctccatttataagtaggtgcactgtctcctgtggggttggaatggcagaggtatcatgaagcttatttcattcgccagtggcgtgtacttatttatttatttatttattctttccccagtattttattcactgggttgaacaattcagactttaggtcaataggtggtgtccacaggtaaaatctggctgttgctaaagcaggtatcatgatcctttcttaagaaaagatagttttaaaataaaacttactttcttaggaaatacctgtataacaatattagaaaatttgatttattcagggtgagtcccactaaagatttactttctcctcacgtgatatatgatacaaatcattacatgatagtaaataattggaatgccaagccaatattactaattagatattttcccttatgtcctattgatagcatagtaacccaatatacttttgaaaacaattagaataaactagttaacaatactgtgggctaactgtaatcatagatatacaataaatgttttaaaccaacaaaactaaggagggacatggtaaataggaaatgttcagttatctaaggatttttaaaactgtgtcatttagcgctgtgtactgttgaaaaaatgtaagattttaaaggaagactgtgtcaatgaattatttatctacaaatttaacattagccacttttatttaatgactcaaagagtattcttccttttttatttcttattaagaaaatacaggaggtgatacgtactctctaccttcctatgaaggcatgagatccttacctctcaaaggattgacaactacaaataatgttataattggtaaattttttaaatccagtattctattatctgtgcagagtcaacgatatcaagttcctgatattcactgagaaatttgtgccattgtttgtagttttcttaggaatgtttttgttttaaacactgagtggcagctgagccattaacattatacaatgaaattgagtctgccagaaatctaccattttttcttccattgttttttctttcatgtgactagaagacatcattcatgatgccgtgtatgtctgtcagtatcttctatttataaacaatccccaagacaaaatataatattcctagctaaataatagtaaaagtaactatgtaaataggaaaagactctcagcttaatgtaagatgctttggttgttaagtaaaggtttaaaacatttcatagcaatggctatgtctgtggtgtttgactataatgtctgcttatctttggcaaacttcaccatattcataggctttgttgagtctcataggttatacctgaatcaaaaaacaaaaagacaaaaaaccaacaacaacaaaggttgagtatctgcaaatgagtcatggagtgttattttatagccctgaaaactagaatgtgtgctctggttgcctggctgaaggagagtaccaggttttcatgttcccatccagcttggctttttggatgagattaagtttattcatcacatagtagccaaatactagtatcttggacccttgtgaggagcattgtccataataggtagtccaaatatagcccagcaatctcaggaaatgggcagacgtcacttatactggatgtccacaggcagaatacagagttctttcattgaatgtccttacgaggcacaataagaatggctaacatggatttatatcacagacaataataaaggtggtctgtagggccctaaaagttctagtactgccaaaattttcaggggtcttcaattactgattttatttttctccatgtcatggttaaccacaccttttttcactcctgtggtggcctgtttatctcctctttgtttgtgatgtatgttttatttgcttttagtaattgctgtctcttaagtattattgcaaaaatgtttgcattaactatagatgacctttcatggtttttatcatgatcatatttattttttattagcctataattctgtttgaatatatagtcatgttaacatatttgtcaatgttcctgtcacgcagctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccaggtaataataatgtaatggaaacaatttcagtttctgcttaagggatccaagaaggagtttttgttcttataataaagaaaatttagctttaggaaaaaagcagaatgaaaatgagactaaaatgtcaaagataaaaaattattccatagactatatctatctcagtttatgcaggtggtattcagtttagaatcattagataggctaaatgaattcatggaatatcatgattagctttcatttcttttttaatattttgttatttagtttaagttttgggatacatgtgcagaacgtgcaggttacataagtatatgtgcaacatggtggtttgctgctcctattgacccatcctctgagtttcttcccctcacccccagcccggcaacaggccctggtgcatgttgttcccctccctgtgtccacgtgttctcattgttcaactcccactttggagtgagaacatgcagtgtttcgttttctgttcctgtgttagttggctgaggatgatggcttccagcttcatccatgtccctgcaaaggacatgatctcattactttttatggctatgcagtattccatggtgtatacgaaccacattttctatatccagtctatcattaatgggcgcttgggttggttccatgactttgctattgcaagtagttctataataaagatacatgtgcatgtgtctttatagtagaatgatttatattcctttatgtacatacccagtaataggattgctgggtcaaatggtatttctggttctagatccttgaggaatcacagtgtaaaaacaagcctctttctccacagcctcgctaacatctattgtttcttgactttttaataatcgccattctgactagtgtgagatggtatctcattgtggttttgatttgcatttctctaatgatcagtgatgttgagctttttttcatatgtttgttggctgtgtaaatgtcttcttttgagaagtgtctgttcatatcctttgcccagttttttacggagttgttcatttttttcttgtaaatttgtttaagttccttgtaaattctggatattagacctatgtcagatgggtagattgcaaaaattttctcctattctgtaggttgcctgttcatgctgttgataagtttcttttgctgtgcagaaactctctagtttaattacatcttatttgtcaattttgacttttgttgcagctgcttttgggattttcattatgaagtctttgcccatgcctatgtcctaaatgttattgcctaggttttcttctagggttttttatggttttgggttttacatttaactgtttaatccatcttgagttaatttttatataaggtgtaaggaatgggtccagtttcagttttctgcatatggctagccagttttcccagtaccatttattgaataggagatcctttccccgttgcttgcttttgtcaggtttgttgaagatcagatggttgtagatgtgtggtgttatttctgaggtctctgttctgttccattggtctacatctgttttggttactgtagtcttgtagtatagttcgaagtcaggtagcatgatgtctccagctttgttctttttgcttaggatcgtcttggctatatggggtcttctttaattccatatgaaatttaaagtagttttttctaattctgtgaagaatgtcaattgtagcttgatgggaatagcactgaatctataaattactttgggcagtgtggccatttttacgatattgattcttcctctccatgagatagaatgtttttccagttgtttatgtcctgtcttatttcattgtgcagtgcttgctttgtagttctccttgaagaggtccttcacatcccttgttagctctatttctaggtattttattctctttgtaacaattgtgaatgggagttcattaatgatttggctctctccttgtgtattgttggtgtaaaggaatgctggtgatttttgcaaattgattttgtatcctgagactttgctgaagttgattatcagtttaagtagtttttgggctgaaatgatggggttttctaaacttaaaatcatgtcatctgcaaacaaagaaaacttgacttcttctcttcctgtttgaataccctttatttctttctcttacctgatagcccttgccagaacttctagtaccatgttggataggagtggtgagagagggcattcttgtcttgtactggttttcaaagcaaatgcttccagcttttgcccatttaatatgatattgctgtgggattgtcataagaagctcctattatcgagctgtgttccatcaatacctagtttagtgagagtttttaacatgaaaggattttgaattttatcaaaggccttttctgcatctattgagataattgtgtactttttggctttggttctgtttatgcgaggagttacgtttattgatttgcatatgttgaactagccttgcatcccagggatgaagttgacttctggtggataagtattttgatgtgctgctggattcggtttgccagtattttattgaggattttcacatcgatattcatcagggaaacgggccagaattttctttttttgttgtgtctcttcctggttttggtgtcaggttgatgctggctttataaaattagttagagaggagtctctccctttcagttgtttggaatagtttcagcaggaatggtattaggtcatctttgtacctctggtagaatttggctgtgaatctgtctggtcctgggctttttttggttggtaggctattaattactccctcaatttcagaactgttactggtctattcagggattcagcttctttctggtttagtcttgggagggtgtgtgtatgtgtccaggaacttatccatttcttctaggttttctagtttatttgcataggggtgtttatagtattctctgatggtagtctatatttctgtggggtcagtggtcatatcccctttatcatttttttattgtgtctatatgattcttctttattttcttctttattagtctagctagcattctctctattttcttagtttttcaaaaaaccagctcctgaattcattgatgttttggagggtttttcatgtctctatctcttttagttctgctctaatctcagttatttcttgtcttctgctagcttttggatttgtttgctgttgcttctctagttcttttagttgtgatgttagggtgtcgatttgagatctttccagctttctcatgtgggcatttagtgctataaatttttctctgaacactcctttagctgtgtcccagagattctggtattttgtctctttgttctcattgttttcaaataacttcttttctgcgttagttttgttatttacccaagagtcattcaggagcaggttgttcaatttccatgtaagtgtgtggttttgagtaaatttcttaatcccgagttctaatttgattgccctgttgtctgagagactttgtaatgatttcaattcttttccatttgctgaagagtgttttacttccaattatgtggtcaattttagaataagtgccatgtggcactgagaataatgtatattctgttgatttggggtggagagttttgtagaagtctattaggtccacctgatccagagctgagttcaagtcctgaatatccttgttaattttttgtctcgatctgtctaatattgacagtggggtgttaaagtgtcccactattattgtgtgggagtctaagtctctttgtaggtctctacaaacttgttttatgaatctggatgctcctgtattgggtgcatatgtatttagaatagttaactcttcttgttgaattgttctctttatcattatgtaatgcctttttttttgtctttttaaatctttgttggtttaaagtctgtttgtcagagactagtattgcatcccctgctttttttttttttaactttccatttgcttggtaaattttcctccatctctttattttgagcctatgtgtgtctttgcctatgagatgggtctcctgaatacagcacactgattggtcttgactctttatccagtttgcaagtctgtgtcttttaattgggggatttagcccatttacatttaaggttaatactgttatgtgtgaatttgatcctgtcatcatgatgctatctggttattttgcacactagttgatgcagtttcttcattagtgtcattgatctttatatctcggtgtgtttttgtagtggttggtactgccttttccattccatatttagtgcttcttttaggatctcttgcaaggcaggcctggtggtaacaaaatcccttagcatttgcttgtctggaaaatattttatttctccttttcttattaagcttagtttggctggatatgaaattctgggttgaaaattattttctttaagaatgctgaatattggcccctagtctcctctagcttgtagggtttctgctgagaggtccactattagtctgttgggcttccctttgtaggtgacctggtctttttgtctggctgccattgacatttttgccttcatttcgcccttagagaatctgatggttatgtgtctttggttgatcttctcatggagtgtgttagtgatgttctctgtatttcctgaatttgaatattggcctgccttgctaggttggggaagttctcctggataatattctgaagtgtattttccagcttgttttcattctccctgtctacttcaggtactccaatcaattgcaagtttggtttctttacgaggtcccatatttcttggaagctttgtttcttttcattcttttgtttctttagtcttgtctgcatgccttatttcagcaaggtggtcttcaaactcttagattttttcttccacttcgtcacttcggctattgatacttgtgtttgcttcatgaagttcttgtgctgtttttttttcagctccatcagatatttatgtttctctctaaactggttattctagttagcagctcctctaaccttttatcaaggttcttagcttcctttagctcagcgtagttttttattacccaccttctgaagcctacttctgtcaatttgtccatctcatcgtctgtccagttctgcgcccttgctggagagatgttgtgatcattcggaggagaataggcgctttggcctttgggtttttggcatttttgttgttgttgttgattctttctcatcttcttgagtttgtctagttttgagtttgagtttcagtttgtctgttttctttgaggctgtttacccttggatagggttttttgtggggccttttttttgttgttgttgctttctgtttgtttttctttcaatgatcaggtccctcttatgtaggactgctgtggtttgctgggggttcacttcagcccctattcatctgcttcgctcctgcccctggagatatcactcaaggagactggagaacagtacagttgggtgcctgcgccttcttctgggatctctgaccttgagggtcagcaagtctgtgtcttttaagtggaaagtttaatttgtttaccttaaaagttactatttgatatgtgagggcttatttatggcattttgttaattgatttatggttgttttatatatcctttgctcctttcttattgtttatcattgtggttttttagttttctgtagtggtagcatttgagtcctttctctttcttatttgtgtccttgcttcgtcagggagttttatactttcatttgtttttatgatggcaaatattgtcctttcacttcctgaagcgtctgtttcaggtcttggctagtggtaatgaatttcctgtttttgcttgtctgaacatagctatcataatactgaagagggaaaggtgaaagctttttttttttttttttttaaagaactggaacaacacagagatgcccacttgcaccactcttgtttaacatagtactgaaagtcttcagactgagcaattaggcaaaagcaagaaattaaatggatctaaattggaaagaagggagtcaaattgtacctgtttgcaggttacataatcttatatgtagaaaagcataaagattctatcaagaaactgttagtactgacaaatgaattcagtaaagttacagaatgcctaatcaacacacaaaaatcagtagcattttcatacatgaacaatgactaggagaaaaggaaatcaagaaggtaataccatttacagtagctacaaataattaaaatacttaggaataaatttaaccaaggagatgaaagacctagaaacttttaacatatacattttaacttgttaaaatatttttcagatttatattactaccagtgagatgtaataatgttattcatataggtctattctttttcttcattttggtcttatttttgctactacatctatatatgttgtggacccaacagtactttaataaaattattactttatataattttatatcttttaaataatttgagtgatgaaaggaggataagtatatagttatagcttttattatattaatctttttaccatttctggttttctttatttgttgccatggccccaaaccatcaggtatcatacctttagcccaatacaggttttcttgactcacctattttgtgcttttattggcaaacatgttacatttttatggttataggacaaataataccattatatacatatatttaaaaataattccttaaaaatatcaggtaatagaaaaaaggaaaataaatatgcatttcctatttttattattacacagtaattaccagtactgtttttctttttgcatggagttgaactaccgtctgggtcacttgctttccttgaacaacttcctttagtatttcttgtatggctggccttctagcatctcattctcctaattttttaatatttaggaatgtcattatttctccaattttctaaaggtagatttgcttgatagaggattcttagttagcattgttcttttgagtatatattattatactgcttactggcctctattatttctgatttaaaatcagttgttaatcttattgggcttttttgtaagtgagaaatgattttatctctttcttctttcaagattttgtccttgttgctttcatcattttaattataatgggtctttttgtggatctctttgtgtttgtcctatttagagttttttaggtttcttggatgtgtaagttaatatttttcatcaaatttgagttttcagaaatgatgttttcaaataatttttattttcttttctctttctccctcctctctttccagtgtttctattattcatgtgatggtaaaattaatgatgtcccatatgtttttccaagctctgcttacttttctccattcctagttctctctgtattttagattatataatctgtcagtctatctttaagcttgctgattatttttctaccagttcagatcttctgttgaattcttctagtgtatgttattgtacgtttctacttcatttgtttttttcttaaaaatttttatttctttgttgatattctctatttgatgagacattgtcatcatacccttcttcttcaggcatgatttctccctcccctcccctcccctcccctcccctcccctccccttcccttcccatttatttattgagacagagtttcactcttgttgcccaggctggagtgcagtggcgcaatctcagctcactgcaacctccgcctcctgggttcaagcaattctcctgcctcagcctcctgagtagctgggattacaggcatgtgccaccacacctgactaattttgtatttttagtagagacagagttttgctgtgttggccaggctgtccttcaactcctgacctcaggtgatctgcccaccttggcctcccaaagtgctgggattacaggcatgagccaccgtgcctggcccgttattttttatatctttaattatttttgaatatttttgtctctttttttttcctgagacagagtctctgttgcccagcctggagtgcagtggcgcgatctcggctcaccgcaagctccacctcccgggttcacgccattctcctgcctcagcctcccaagtagctggaactacaggcgcctgccacgacgcctggctaattttttgtatttttagtagcgatggggtttcaccgtgttagccaggatggtctcgatctcctgacctcgtgatctgcccgccttggcctcccaaagtgctgggattacaggtgtgagccaccgcgtctgacctatttttatcttttatgtgtattctttgtttaaatcaactctctctctttttttaatctcctggtttttatggtgtttttgaattttttattttgagatttaatttagaatttttttttctcttccatgtcagggtttggcaaaccaaggtcggtaggccaaatctggtgtgctgcagatttacgtaaacaatgttttatcaaaatacaactctacccagttatttgtgtattatgtttgtttgcttttgcactacagttgcagaaaggaatagttgtgatagagactgtcctgcaaagcataaaatgctatctagtcctttatgtaaaaaaagttttaccaattcctttcttgtagtatatttgtataacctgggttgtggatgtatctacaagggccatttacatctgcttttacaatatctatggggctttttctgttttcagagcaggtttgtattaatattttacttggtggtttattcaccaaatatatgatgtgaatttaagattgccatataagcctgacatatactttaagttcccacaagttatgtttttctttcataaacatatcccaggggacttaaaattcttttctgctttttgtagagcttgtgatgtgttttaatacctttttcatagatagtgtctccagttgataggatcattttatgaacatggttcagtttagcttgcttcctttaggatgccaagaattatatcctcttggtctgctggattttggaacccatgcctcctagttcttattcgtctattccacgtatagtaaaatttggtcgctagctcaaatttagctttactattcttattttgaatctctgcttcatttctagcatctgataattcccatttcttttaaagtggtatatgtgttgaaaaatgctttgggtaaatttttgtcttaaatttctgtgtatatttttaaaatttattaagattgtcacaaagatatttttaaatgttgcgcatctgttgcagagtaactatttttcaaaactatgtacttatttgcatatcaaatgctgagttgtcattatattttattttgatttttttctgtttgtgtgtccataaatgaggagccatctggagtggttttaaaatttagagaaaatagaatggatgacttctctttagttttattcatattccatagctactgagatattagatgatattagaacctttcaagcaacaatgtaaacctcaacactcttatgtgcaagctgacattacctgtcgatctaacactcttttggtagtggggaatagaacataaccataggcttactaatataccattttcttgttatttgatacagccattatgcctgggtccccttttctgtaatatactttctcctttgccattgctaccatattagttataaggtgtgacaattaccagacttttttcagcagatattttttctgcaggtaggtctaaagtatactggctttctgcatcatatatagaccatgtcaggcttccttgatttatactttccaccagatggatgaaggaataccagtgatatgcttcttgactgccctatgactaacctttgttttcagaatttttcttattcaggaaaggagggttgagtggcattttgctagggaacttcttttatcatcaagaggtattatagattactaccttctagttttgttcatgtaggtcaccataatgcctatcattgctggtacatttacttattattttaccattaatctgtgagggagatgttagatatgagtgctaaatttagctgtcttattcagatgttaaaacttttttttttttaatgattcttccaaatggccagaaatttcatgaagttgttacagtaacccatttcttactttaaatcttctggtaagtctttacatgtagtgggcactcaataaattttgtttttacctgagtgaattaattagtggtgtcacagagtaaattttctatgaaacagtaccttgccagggcaactaggcaggagaaggaaataaacggtgttcaattaggaaaagaggaagtcaaattgtccctgtttgcagatgacatgattgtatatcgagaaaaccctattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttaaagggacatgaaggaactcttcaaggagaactacaaaccactgctctaggaaataaaagaggatacaaacaaatggaagaacattccatgctcatgggtaggaagaatcaatatcatgaaaatggccatactgcccaaggtaatttacagattcagtgccatccccatcaagctaccaattactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgcacatctacaactatctgatctttgacaaacctgagaaaaacaagcaatggggaaaggattccctatttaataaatggttctgggaaaactggctagccatatgtagaaagctgaaactggatcccttccttacaccttatacaaaaatcaattgaagatggattaaagacttaaacattaggcctaaaatcataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaaacaaacaaccccatcaaaaagtgggcaaaggacatgaacagacacttctcaaaagaagacatttatgcagccaaaaaacacatgaaaaaatgctcaccatcactgaccatcagagaaatgcaaatcaaaaccacaatgagataccatctcacaccagtgagaatagcagtcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaatgtggcacatatacaccatggaatactatgcagccataaaaaatgatgagttcatgtcctttgtagggatatggatgaaattggaaatcatcattctcagtaaactatcgcaagaataaaaaaccaaacaccgcatattctcactcataggtgggaattgaacaatgagaacacatggacacaggaaggggaacatcacactctggggactgttgtggggtggggggaagtggggagggatagcattgggagatatacctaatgctagatgacgagttagtgggtgcagcgcaccagcatggcacatgtatacatatgtaactaacctgcacattgtgcacatgtaccctaaaacttaaagtataataataataaaaaataatttaaaaaaaagaaacagtaccttaagcttttaaggataatgttataaaattaaagtttttaataacattattgtaaagataatattaatttattatagacaattggtaatacagaaaaatcttactttagtaagatacccatcagcttttccataaacgtatttatacatttcatcacaaaattgtcactatgttaaattgaaacaaaatatgcacatgtttcacacggttcaatgcgatgttttaatacaggtatatgttgtataatggtcgaatcatggtaattaacatatctattaccttaaacatttataatgtgtttgttgtgagaacattcagaatcctctcttctagctatttgaaatgcattattgttagctataatcaccttactactgttcttgtactctattgcatcataggtattcctcctatgtgtaatattgtatgcattaaccaacatgtccctatctccccctcctcctattctctccagtttcttgtaatcatcattatactcttaatgtctatgagatcttttttttaaagataccatatatgactgagatcatgtggtgattgtctttctgtgcctggcttatttcacttaagaaaatgtcatctaaactcatccgtgttgtcccaaatgatgggattttattttttatggacctttttcatggctgaaaaatatttcattgtgtgcatgtgtgtatgtgtatttatttgtttattcacactttctttatccattcatccatgtttggtatttaggttgatcctatattttggttattgtgtgtagtgctgcaatatattaatacattgaagtgctgatgtctcttcaacatactgattttatttcctttggatatacacccagtagtgagattgctggatcatatagtattatatttttattttttttgagaaacctccaactgtttttgatgtaccaatttacattcccataaaaaatgtatagagttcccctttctccacatacatgccagcatttgtttttttcactgtcaattttataatttacccatggctgtttaggagcatgttctttaatttctatctatttgtatagtgtttgaagttccttctcttttcttctagttttatttcattatggtcagaaaagatacttcatatgattttgatatatttaattcattaagacttttttcctaacatattagctaacctgaagaatgttgcatatgcatttgagaagaatgtgaattctgcagcttttggatggaatattttgtatatgtgaagtcatttttgtcataaattcagtttatgttcagtgtttccccatatattttctgccttgatgatctgtcgattgctgagagttgggtgttaacattcccctactactattgttttgctttctatacctccctttggatctattaatgtttgctttctatattaagttactccaatgtgcattccatataaattctcgattgttctatcctcttgtattgatccctttatcagtaagtattgacctcatttatctctttttatagtttttgacttgaagcctattttgtctaatagaagtatagttaatcctacttacttttccatttgcgtgcaatatgtttttgcatctcattactttaagtctatgcacattcttaaaggtgaattgaatcttttgttggcagtatgtagttgggtcttgtttctttattcattgactcactgtttgtcttttatttggagaatttaagccctttacattcaaggtaattattggaaggtaaggattttgtactgccatattgctacttgttttctagttgttttgtagaacatttctttctttcttctcttactgcctccctttgtgttaagtgattttctctagcaatatgatttgatttcttgctttttatttttagtgtatatattgtaggcttttgttttttgcttaccttgagcctatcaaaaacatcttattattttaaaaggctattttgaattgataagttaattttggtcggaagaaaaggaaaaacccactctattctttaacttcattactcttctacattttgcatttttgatgtcataatttacatcttatattgtttatcccttaaccaaatcattttagttgttgttatttttatttgctttgttttttaaccttcctaataaggatataattgtttcttgacccacgattaccatgttagagtattctgaatttgtttagatacttatttttacctgtcagttttatagttttgaactttttttgttacacattaggattattattttttctttttgttcgaacaactcctgaaagtattttttttgtaatgtagttctggttgcaagggttttcttcagcttttgtttatctgggaatgtctttagtctttatttctaattaataagtttgctctatacggtattcttggcaggcagttttgttgtctttgaatatgtcatcccgctctctcttggcctgtggggtttctcctggtaactctcctgtcaggcatattggaattcctttatgtgttatttgctttttttttttttttttttctcatgctgctttcagtgttctctgtctttgacttttgagaaagtggttatatatgtcttagggttatcttatttggattgaatctgttttgttacctttcacctttctgtacttgaatatttatatctttcttcaggtttggacattttctgttattttttttaaataagctttcttccccattttcattttttattcttttttgaacactaatgatacacagatttgctcttttgacactgtttcatagaacctctgtgtttttctcattgcttatctgttttcttctctgagtgtgtattttccaatagcttgtttttgaaatcagtgattcttctgctttgtcattctgctattgatgccctttattgcattttttttttttgagacggagtcttgctctgttgcctaggctggagtgcagtggtgcaatctcggctcactgcaacctccacctcctgggttcacgccattctcctgcctcagcctcccaagtagctgggactacaggcgcccgccaccaagcctggctaatttttttgtatttttagtagagatggggtttcaccatgttagccaggatcatctcaatctcctgaccttgtgatctgtctgcctcagcttcccagagtgctgggattataggcgtgagccaccgcaggtgtgaggcctgcatttttcctttcatttattattctttttagctcctggattactgtttgattttttaaattatttcaatttgtttgttgaatttctctaacaaattcctcatttgttcctctgtgttgtattgacattgctgatttttcttaaagcagctatattttaattctttgattgcctatgatttatgtgcatatgtttaggattagtaattggcaccttgttttgggcgtttcatgaggccatcttttccaagctaatcttatatcttctttacatgtgtctctgtatgtttattgacaaattaggtatttttttccagtctttgcagtctggatttgtttgtgactgctctgtttcggtgggcttgttgacatattctgagcatactgactcttgtatttcattttagtgctagaaggtgctctgagcccagctttgacatgattgtctaatgcaggatccaaactcattgtgatcatgggagatccatattgggtgcccaggccatgtaagagatcagggtcagaccctcacatatgaaggattgtagaccatccatctgacattgtggcactcataaacatcctctgtggtggggcatcctctctgccagggatggtaagccactgccaagttctctgtgctgcctgttactagccctactctttcttttttccataggtggcctcaggtggttcagccccattgtacttgtgatgctcttcatgggctgatgcagaagcaaatctcccatgaagggattcaggatggtagagaagcataatgcctatctccggcttcctcttttgagtgtagaatccctgagtcctggagacctttctgtgtatagtactctaagggcttggggatggggtattgtggtcacagaaaactgattctcttaccatccaaccatacttttactagtctgtagtctggagaggcttcacagccttacttgtgcattcaggttttttttagccctcgtgaaggcaattgtatgtgtgagtggttgttcaaattgatgtttcttcgtgggtataattgttggagaaacctattttgctgtttgctctgcttccttgaatttaacattgccatctttctaaatataatgctctgtattaattgcttctcttaatttgtcatgaacattattccttgctattaaattttctaattgtttcataatgtaatatggagtttaaaaacattataattattctcaatttcataaagaggatgatgagcattttttcataactgcatattctttctataatgtgttacaatagacttgcacctctaagaatttctgtaaagtatttggttttactcttttgtttgtctgtttcttcacatgctaattcattttgatgatcctatgctagcctcttgggaattcctctcactttcagattttctgaatataagaggcagttttacatgctatttaatatctgttttttttttacattcaatgttccatatacatatttgtttctgtcgttgattagctgtgtgactttgtgtagttgcttaacccagatttctccatcttagaatcagtcctgaacacagcaacttccacatagcattgttttgaagattaaataataaaattcatatgtacaatttggtcctctgtctggccaaggcatggtgtttacagtgtttaaaaattgatgcttatgtacacttaccaatcagaacagataccaactacaaacaattggcaccagcagaatattggctttcctcatggagtgagagagagctcagttaaatgctagttgctatcatagttgtaataagtaaaaataatcatgagggtgacaattaagatgatttttggccaagcagttaccagactaagttaattttatgtcccaaataggcacaaagagcatgagcctttcatacatgaactttattctgaaatttttatattctgctgtaatattaacatcgaaacatggaagtctcagttacacagatatataaacaatctcatactttatatttcattctgtttagttcaaacttaaatagactttcagttaaatcttgaagtttttcttacctaaagaagatacatatttatgcaaattaattcaaaagtacttttttttttttttttgagacggagtcttgctctgttgcccaggctggagtgcactggcacgatctcggctcactgcaacatctctctcccaggttcaagcgaattctcctgcctcagcctcccaagtagctaagattacaggcatgcaccaccatgcccagctaatttttttgtatttttagtagagacagggtttcaccaagttggccaggctggtctcaaactcctcacctcaagtgatctgcccacctcggcctcccaaagtgctgggattacaggtgtgagccaccacgcctggctcaaaagtactatttttattaattttactattagtttactttattctggttagaatctattgccacactattttctatattgattgactctttattatcatgtgttaatataattaagatgaattttagcattctttatcaaagttatagtatttagccttgtgtttatataacttaacagacataccattcttatgaatttttaaggattatgctaaagattattccctctttagctataacttttatgttccagttcatctttaaccatggcattgtaaagaggttaaggtaaaatttcaacacatgatttatggtacatactgtcttgcacaaaactttgagctatatgtgttattaatttttaaacaaaacttggaagatgctctttgggcacttttacaatccagctttttaagatacattctttgttttgatagctattatacttgatattatgttagatatttgtaatgctttttactgtttcctttagcttgccagtgtaatggacatagcacttgcatcaataataatgtgtgcgaacagtgtaaaaatctcaccacaggaaagcagtgtcaagattgtatgccaggttattatggagatccaaccaatggtggacagtgcacaggtaagtttcttttaagcaaattttggtgtatttttactaaggaaaagataattaagaaagcagcgcctgttgtggagaatatatactactacagaaaattttttactcagttttagtatgttttctaaagtaatacatattagaaactgtgaactataaaaattctgtaatatgcttgattcaaaaatattcctttttcttatttcaaaatgaatgcatgtttcttattgtaatttctcaaacacagataaataaaagaaaaaacacctactatctcactattcaaaaataatcattgctgatagtttttttaataagtaataatttattgttttgacttcagaaataataattaaaagttaaatgtgtttaacttacatcaggtaagatttttattgcacagggtggtagtatagagtagtatctaggagagtatgggtttggaaccaaatctgggctgaaatcccaactctgtcactgttcaaatgtatgaccttggttcattaacctctcagtgtcttatttttcccatatgtaaaatggagatgataataattcactgagttgttgtaaaggtcaaatgagattttatgtaatataggccttaggaattgaagcacataaaaaagagcattataaatgctagccataatcatcacattcttgtttactaaaccctactttcctccatcttcctctctattctgccacttctttctcctactttgtaaataatatttgttctttaaatataatttccttttaaagtagaatttaatagaaatccttcattatctctagattggaacttgtcttttaaatttttaatctaccgtctctaaatggagtttgcctacatagcacccacagaaatacgtttttggctgtgaagatgtgaggaatttgagggagtggagcctgactctggttagataatttttttttaacactagctgcatattagaaccagctggaaagcttttaaaaatatggctgtctgggccactttctaaaacaattaaatcattatcttggttgtggttgtagggtgattcttaggtaattgttctttttaaatgtttcccaagtgactaatatgcactcagagttgagacacatggggaatgatgaactgattcaacatttgagtcaacaaaattgtgcagctaatacagttgtaccttggtatccatgcggattaattccaagacctttcctgtgtaccaacatctgcagatggtgaagtcccttacatagtggtgtagtatttgcataaaactgatgcatatcctcctgtgtacttcaaatcatctttagttgtaattcctaatacaatgcctatatttcacttcattcacatggattcaaagtatacttggtgcatggcaaatataaattttacattttggaatttgggggattttttctgaatatttttgatctgctgttggttgagttcacagatgtggaacccatgggtaaggagggcctactgtagtatgttgggtgacaaataaagataggtgaatggaagttttgtgttatgcagtgctctgatccatttgaagctctaatacagatgcattggcccacatttaacattttttatatcctaggcaccgtactaatagctttattgtcattattttatattagctttacaaaactgtatggtattactttgatcctcattttacatgtggacacaaatatttaatgcacaaagaagttatctaaaatacccaagatcatattgctagttagagtaagaaaatgtctcattcctaaacctcgctcttaactgttaatgcaggagttatgttcatatggaccaggaagatccagttgttctcacctaaaagccacagcttagtgctctgtccagtggatacataagatgcagtaattatgggccaagtggaatccacaaaatttagggtctacatactagagtcatagtgttttttaattttatatttctaaaaagaccaaggttttcaagacaagctctttctaaagtgtttcagtactgaattttccatggccatacattttattggagaaagtgcatgtgtcagataggttatgtgtgttaatgtattgattgcataatttgaagaaaaaatatactatgagatgttttcattcacattacaatttgtgtgtctctgtaaactgtcgtgtatttaatataaaattgtggtatgttttattttacttttatgaaaattattttggatatattttccaacatattttcatgcccatatgtaattagttcattctgtaatttacttaatatatttctgttggcatttatataatgcttctaaccataactccaattcttgagaatgactttttagcaaagtgaaacccacataacagacacttaactatgtacagtgttgtgcaactgtctgatttttttttctttttttttttagacagagtctcgctgtgttgcccaggctggagtgcagtggtgtgatctcggctcactgcaacctctgtgtcctgggttcaagcaattctcctgcctcagcctcccaagtagctgggggggggggactacaggggcccgccaccatgcctagctaattttttttttttttgtatttttaatagagatggagtttcactatgttggccaggctggtcttaaactcctgacctcgtgatctgtctgcctcagcctcccaaagtgctgtggttacaggcgtgagccaccatgcctgggcattttttaaagtttttaattaaaaagaattcaatttttaattttgtgggtacatagtaggtgtatatatttatggggtacatgaaatatcttgatacaggcatgcaatgtgaaataatcacttcatggagaatagggtaacctgctcaagcatttatcctttgtgttacaaagaatctaattacactctttaagttatttcaagttattttaaaatgtacaattaagttgctactgactatagtcaccttattgtgctatcgaatagtaggtcttcttcattcttcctatttttttgcacctcttaactataccccctgccctccagccctctaactattgtttttgtacccattaatcatccctaccttctccccagcaccccattacccttcccagcctctggtaaccatccttttactgtctatgttcatgaattcaattgttttgctttttagattccgcaaataagtgagaacatgcaatgtttgtctttctgtgcctgtcttatttcacttaacatagtgatctccagttctatccatgttgttgcaaatgacaggatctcattcttttttatggatgaatgccataaaaaatatataccacattttctttatccattcatctgttaatacagcagtccccaacatttttggcatcagggagtagttttggggaagacaatttttccacggatggggtggtggtggggtatagtttgtggatgaaactattctacctcagatcatcaggcattagttagattctcataaggagtgcgtagtctagattcctcacatgtgtagttcacagtagggtttgagctcctatgagaatctgatgccaccacagatctgacaggaggcagagctctggcctgaatgctttttcacccgctgatcaccttctgctgtgcagccggttcctgacaggaaatagactggtaccagtccatacccaggggttggggacccctgtgtaatggacacttaggttgcttccaaattttatctattgtaaacattgttgcaacgtaggagcgcaggtatctctttgatataccagtgtcctatttttaaggtttatacccagccatggaattgctggatcatacggttgctcaatttttagtgttttgaggaaccttcaaacttttctccatagtacttgtactaatttacattctcaccaactgtgtacaagggttctgttttctccacatcctcacaaacatttgttattgcctgtctttggatataagccattttaactggggtgatattacagttctgatttgcatttctctgatgatccatgattttgagcacctttgcatatgcctgtttgtcatttgtatgtcttcttttgagaaatatctcttcaaatattttgcccactttttgattggattattagatttttttctgtggcattgtttcagcttcttatatatttgggttactagtcctttgttagatgggtagtttgcaaatattctctcccattctgtgggttttctcttcactttgttgattgtatcctttgctgtgcagaagctgtttaacttgttgtaatcccatttgtccgtttttgctttagttgcctgtgcttacagggtattgtccaagaaattttggcccagaccaatgtcctggagatttttccccaatgttttgttctggtagtttcatagtttgaggtcttagatttaagtctttataccatatgctttttatatatggcaagagataggctctagtttcattcttctgcatatggatctccagttttcccagcaccatttattgaagaatctgtcttttccccagtatatgttctggtcacctttgtcgaaaatgaattcactgtagctgtgtcgatttgtttctgagttctctgttctgttccattgaactatgtgtctgtttttatgccagtattatgctgctttgcttgctgtagctccttagtataccttgaagtcaggtaatgtcattccttcagttctttttgctttggatagctttggctattctgggtcttttgtggttccatatatattttaattttttttctgtttctgtgacaaatgttactgttattttgagagggattgcattgtatctgtagactgccttgggtaatatggacattttaacaatattgattcttccaatccatgaattgattcttccaatgcatttttggtatcctcttcaatttctttaattagtgttttatagtttccattatagagatctttcacttctttggttaattcccaggtatttaattttatgtgtggctattataaatgggattactttcttaatttcttttttatattgttcactattggcatatagaaatgctactgatttttgtatgttgattttgtatccttcaattttactgaatttatcagttctaagatttttatggagtctttaggtttttccaaatataagatcatattatctggaaacaaggataatttggcttcctcctttcctatttggatgccctttatatctttcttttttcttattgctctagctaggacgttcaggactgtgttcaataacagtggtgaaagtgggcatccttattgtgttccagattttagaagaaagcctctcaattttcccccttcagtatgatactagctgtgggtctgtcatatatggcttttattaggttgagttatgttccttcaatccccaattttttgagggtttttatcatgaagggatcttgaattttatcaaatgcgttttcactgtcaattgaaatgattagatcatttttatccttcattctagtgatatgatgtgtcacatggactgatttgcatatgttgaaccattcttgcattccagggggataaatcccacttggttatgaatgatctttctgatgtactgttgaattttgtttgctagtattttgcaccaacattcactagagatattggcctgtagttttctttgtttgtttttgacatggagtctcgctctgtcacccaggctggagtgcagtggcacgatctcagctcactgcaacctccacctcctgggttcaagtgattctcctgcctcagcctccaagtagctgggactgcaggtatgtgccaacaagcctggttaatttttggatttttagtagcgatggagtttcaccatgttagccaggatggtctagatctcctgaccttggcatctgacagccttggcctcccaaagtgctgggattacaggggtgagccaccacacccggctagttttctttctttttttttcttttcttttcttttctttttttttttttttggtgtgtgtgtctttgtctggttttaatatcagggtaatattggccttgtagaatgagtttggaagtatttccttctcctctatttttcagaatagtttgagtaggattggtattagttctgctttaaatgtttggtagaattcagctgtgaagccatcagaccccaggcttttctttattgggaaactttttattataccttcaataacattacttgttattggtctgttcaggttttggatttcttcccagttcaatctcggtaggttgtatctgtgtaggaattttttatttcttctagatgttccagtttattggcatgtagttgttcatagtagccactagtaatcctttgaatttttgcagtatcctttgaaatgtctccttttcctttctgattgaatttttttgtgtgtcttctctgttttttcttagtttgtctggctaaaggtttttctattttgtttaacctttcaaaaatcaaccttttgtttcatcagtcttttttttattgttttcttcatttcaattttattatttctgctttgatctttcttattttcttctattaattttggttttggtttgctcttccttttctagtttttaagatgcatcattagattatttgaagcttttcctctttttttgatgtaggcacttatagctagacacttcctcttagtattgctttgctgtatcccataggttttagtatgttgtgtttctattatcatgtttcaagaaaattttcagtttccttcttagtttcttcattgaccctctggtcattcaggagcatattgtttaatttccatgtatttgtaaattcctcttgttattaatttctagttttattccattgtggtcagagatgatgctttatattatttcagtttttttcaatgttttacaacttgctttgtgacctaacatatggtctatacttgagagtgatccatgtggtgaggaaaataatgtgtattctgcagctgttggatgaaattttctgtaactatctgatagatccatttggtctatagtgcagattaagtcccatgtttctttgttgattttcttcgaagaaagatctgttcatagctgaaagtgcagtgttgaaatctccagctattactttattggggcctatctctctctttacctctaataataatatttgctttatatatctagatgcttcattgttgggtgtatacatatgtttaaaactgttatatcttcttgctgaattgaccgctttatcattatagagtgaccttctttgtctattcttttgtttttcgtcttgaaatctgttttgtttgatgtaagtatagctactcctattcttttttggtttccatttgcatggaatatatttttccattcctttatcataggctacatgtgtctttatttgtaaaatatgtttattgtaggcaacagattattgagtattttttttccatccattcagccactctcttgattgaagagtttagtctatttacgttgaaagctattattgataagtaaggacttacttctgccattttattatttgttttctggttgttttgtgttcttctcttccttctttctttctgtcttgctttagtgaaggtgatatgattgagtttcttggtttttatttcttgtgtatcttgtttttttgttttgaggttaccgcgagacttgtaaatagtacattataacccattatttaagctgataacaacttgacactttttgtggtcctcttttccttctttctttccctcctgtcttcctttagtgaaggccttttttttcctggtgatatgatatagttttttagtttttattttttgtgtatccattgtatgttttttggtttgaggttaccatgaatcttgcaaaaactaccttatagcccattattttaacctaataacaacttgacactgtttgcataaacaaacaagcaaatgaaaactaataaaaactctataccttaacctcatccatctgctttttaacttgttattgtttgtatttatatcttattttactgtcaacatcttgaaaagttgttattatttttgagtggttcattgtttagtctttctatgtaggataagagtattttactcaccacagttacagtgttataatattctgtgtttttatgtgtactcactgttactggtgagttttgtgttttcaggtgattacttattgctgattaatgtcattttttttttctgtttggagtactccctttagcatttcttttaggacaggtctggtgctgatgaaatcactcagcttttgtttgtctgggaaagtctttatttctccttcatgtttgtaggatatatatacacttcaaatatatacattttaggatatatatacatttcaaatgtaaaagttgttttccttcagcactttaaatatgtcatgccattgtctcccggcccataaggtttccactgaacagtctgccgccagatgtattggagctccattgtatgtgatttgttgcttttcccttgctgcttttaggatcctttctttattcttgatctttgggagtttgattgattactaaatgccttgatgtagtcttctttgggtttaattctgtttggtgttctataaccttcttgtactttgatattgatatatttctctagtttgagaagtttcgtgttgttacccctttgaataaactttctacccttatctgtttcacttcttcctttttaagaccacgaactcttagattttcacttttgtagctattctctaaattctgtagatgtggttcattgtttttaatcttcttcttttgtcttttctgacagcgtattttcaaatagcctgtctttaagctcactaattttttcttctgcttgattaattctgctattaaaagactaatgcattcttccatatgcgaattacatctttcatctacagaatttctccttgataccttttaattatttcagtctctttgttacattcatctaatagaattctcaatttcttctttttgttatcttgcatttctttgagtttcgtgaacacaggtattttaaattctctgtttgaaaggtcacatatctctgtttctccaggattggtccctggtggcttatctatttcatttgatgaggtcatgttttcctggatggtgttgatgctaatagatgttcttcattatctgggcattgatcagttaggtatttattgtagcccccactgtctgggcttgttggtacctgtcctccttgggaagactttctagatgtttgaaaggacttgggacttggatgttatggtattagttgtatctgctataggggggaccctaagcccagtaatactttacttacaaactcatagagggactgccttgatggtcttggacaaggtctgggagaattctggattaccaggcagagactattgttctcttaccttattttctcccgaacaaacagaattcctctctctgttctgggccacttaaagctgggggtggagtgacaaaagtaccaccgtggccatcaccagtatgactgtgctggtcagacatgaagccagcacaacattggatcttgcctacagcctgctgtatgcactcactggttactgcctgtgttcgcctaaagtcctggggctctacaatcagcaggtggcaaagccagctaggcctgtgttcttcccttctggatgacgagttccctcaggcccctggtgggtccagaggtgctatacaggagttagggactagagttaaaaaccttagaagtctacttagtgttctattgtactttggctgagctggcactcaaaacgcaatatgcagtccttcccactcttccctcccttttccaaaggcagaagagcctcacctcatagccactgccatcaaaggccatggggagtactgccagactacagctgatgatcccttaaggcctaagggctcttaagtaagcttatggtgaatgctgcctggcctgggactcaccctttaggggagtgggctcccctctggcctagggtaggttcagaagtgccatccaagagttaagtcctaaaattggggatcccaagaccccacttggtgctccatccacctgtgactgtgttagttcctaaggtacaaggcaaagtaccatttacttttccctgtgcttttctctaacataagagttttgccctttagccactgcagctggtaatgtgctgtgtttcacctgaagccagcaagtctcagaggctcacctaagaccctcaacatagaacgtgggtattgctgctggttattcaggacccaagtactcttcagttaaccaggtgatgaatgcttccaggactgggtcctttccttcaagtcagtgggttcctttctggcccagtatgtgtctagaaatgtcgtctggaagctaagacctggaaggagggcctcatcattctgactggtgccaagacaaagtcctctccacttttcccacacctcttctcaggtggaagttaggggtctcttttggaaccacgatttgtgcagtctggggttagaggagaggcaatgccagtactcccttagtcaccccctctgctgtcccagcaggtcctgtgccctccagttcactgtttctgggcccagttcagcactaggacttgcctaagagttgtagtccttatggcccagactgcctttcaacttcatttaaagactcagagcattttagcccttggtggtgaggtcagtgggaactgaagttcagactgctaggattggcgattttcctttgtctagtgctggtttgtatgtgccttctgtaggcgggtgtcccctgagttttgttcagttctcctttctactatagcaggacagcagtgagttcagtccctcacgattattgttttctccctcctttagtgcctagagatactttcctccccgtatactgccactgcagggaggtgggagagggctgatgttggcaattggagaatttttaagaaatcacttcagtgcctctttcactgatagaagttaacaccaggtactatgagggctcacctgatttttggttttatgaaggtgttttttctgtttagatagttgttaaattgatgtccctgttggaggggacgattgatggaaccttctattctgctatcttgctctgtgtctctatcacctttatctatttcttaaacattttttatcatcccaaaaggaaactccgtactcatgaaggagtcaccccagcccctggcaaccactgctctgctatctgtctttacaaatttacttatattctagatatttcatataaatggaatcacagtatgtaacatcttgggatttccttctttcactaaatgttatgtttttgatgttcattctcattgtagcaagtaccagtacttaatacctttttacagctaaataatactgtggttttgatttccatttccttaatgattaaatattgaatatcttttgatgtgcttgctggcccttgtatcttagtttggagaaatacttattcaagtactttacctgtttaaagaaactttgttttcttaaattttggaaaaatatgcataatataaagtttaccattttaaacatttttaagtatacagtttagtggcattaaggacatgtgcattgttttgccaccatcattttcattcctctttaaaactttttaatcttgtaaatctgaaactctataaccattaaaaaatagctacccactcccccacctccttccagaccctaagaactgccattctactttctgtttctgtgaatttgatggctatagatacctcatgttaagtggaatcatgcagtttttgtcctttggtgactggcttatttctcttagcataagccttcatggttcattcgtatgatagcatgtatcagactgtctttcctttctaaggttgaataatgtttcattatgtattagtacattcacaatgttgtacaactgtcacctttatctagttcttacacacatcatattttatctatctatttattcattgatggacacttgagttgcttccaccttttggctgttgtaaataatgctgctaagaatatagcttacaaatatctttgtgagtatttgtgtcttttcatatgctttttagccatttctttatcttccttggagaaatgtctattcaaatcttttacttattttataattgggctttttttgctgttgaattgaaaaagttctatatatcttctagatatgaggctcgcatgagatatatgatttgtattttccaccattctgtaggttgtgttcacttttttgatggtatcctttaaaacgcaaaagtttcaattttgatagtttatctatttttttattttgttgcttatatttttggtgtcatatctacaaatccattgccatatgtaacatcacaatgattatttttttgccaacataggtaaaagtaatatatgaatggctctattagctccaaaatgttttaaattattatggtaagttttactattctaacaggcagagtgcttttaggaatatgttcccctttaaggataatacttctctgctaggttgaagacaagtttagttatttcacattaatttttgttactgacgtgatacatttgacaagccaaagtaaaggcaatgaaaaattaaatagagtgaataatagatgcctgttgtattcactgttatactttctccggtagtttatgaaatttttaaataattctttaagagtttccgtgtttcttaaagttggcaggaaatattttgctgtctatgacttttatatggtgatgtgatgggtaaaagtcatttttattttttggggccacattagctacctaataataaacaataagtcacatctgatgaattattttaatgtagtaatgtctaaaatcaatttataaagcatggaaagtaaacatttattactattctttcatttttagttcactttattgggaaaagctcatttttaaaactagtaaatatacttattaaaattcaaagtgcatgccgatattaagggaaagtaggaaataaatttatatttgactggcaaagctttaaatatactgcagcatatatattattttaaaaatccaacctaataaagccaatctaacattattgtcaattattattatattatggttagtcagttattataagttactcttaaaatgttttattaaaattttatttataatgttcaggaagattctctgattaaaaacttgctttggagatatgtatataaaatatttatgtgtgtatatgtatactatatatatatgtatatgtaatctttgtggctatggaaaaatataacaatgttaaatgcttgggctttggaatcataccacttgagtctacatgctggcaatgccactgtcaccttggataaattatttaacttttaacttaattttattttttgagatgcagtcttgctctgttgcccaggctggagtgcagtggtatgatctcagttcactgcaaccccagcctcccgggttcaagggattctcctgcctcagccttcctagtagctgggacgacaggcacgcgccactgcacccagctaatttttgtatttttagtagagatggggtttcacatgttggccaggctggtctcagactcctgacctcaggtgatccacctgccttgacctcccaaagtgctggaattacaggcatgaggcaccgcgcctggcctatttaactttttagtgtcttagttttctcatctgcaaaatgcagctaatttaatttatgttgtaatggtaagtcataaatgtggtactttatatgttgtataatatatgttcctggcaaatgttaactccctaatcctagctattattgtgatattattattactattcataacatcaataagtttagtattttgataaaaatatatgattcaaacttttatggcagtattatttttgtcatattatttccaatctgacttataaactgtagtaaaagaaactaaattaatatttagttgaatagaagaatggctcagtacattacacattatgttatttgcaatgaaggaatatccttgaactccataaatacttattgaatgcctaataaatgcaaggaacaatgttaggacttgaatttatatacattgtgtgggtgctattatagtgttatgaagaaattgagtgatagaattagtgacaaagagatgaattctcattgaagaatctggtcttggaaggtctttcatttcttcaatatttaaaaaaataattggatatataatagttgtacatatttaaggggtacatgtgatattttaatacaaatagataatgtgtaatgatcaaatctgggtaactgaaatatccatcacctcaaacatttatcatttctttgtgttgtgaatgctccaagtctactcttctggatcttttgaaatatacaataaattattttaaactatagtcactttattatgctgtggaacactagatcttattctttctttctaactgtatttttatacccattaaccatttctatttatcctcatctcctcactagtgttcacagcctctagtaaccaccatttcattcactacctccaggagatcaattgttttagctcccacatatgaatgagaacatgagacatttgtcttttgtacctggcttatttcacttaacataatgttctctagttccatcagtgtcattgcaaatgacaggatttcattctttttaatggtggaataatgttccatttgtgtatatataccacattttctttcattgttcatctgtcgatggacacctaggtggattccaaatcttgcctattgcaaataatgctgcaataatcatggatatgcagatatttctttgatatactgattttccttcttttggatataaccagtagtagaatttctggatcatacgtagttctgtttgtagtgttttgaggaacttccataaacctccatactgttttccatagtggttgtactaatttacatcttgaccaacagtgtgtgagagcatgcccctttttctgcatcctcaccagcatttgttatattctgtcttttggataaaagccattttaactgtggtgaggtgggttgcatttccctgattattactgatgttgaacattttttcataaacctgttggccatttataagtcttcttttgagaaatgtctcttcaggtctttagcccaatttttaattgtattattattattattttgctattgagttgtttgagctccttatgtgttctggttattaatcccttgtcatatgagctatttgcaaatactttctccccattctgtaggttttctctttactttgttgattgttagctgtgcagaagcattttagcttgatgtgatttcattttttcaatattactttggttacatgtgatttagaggtcttactcgaaatctttgcccagaccaatgttctgtagaatttcctcaatgttggctgggcacaatggctcacgcctgtaatcccagcactttgggaggctgaggtgggcagatcatgaggtcaagagattgagaccatcctggccaacatggtgaaaccccatctctactaaaaatacaaaaattagctgggtgtggtggtgtgcgcctgcagtcccagctacttgggaggctgaggcaggagaatcacttgaacccgggaggcggaggttgcagtgagccaagattgcgccactgcactccagcctggtgacagagcaagactctgtctcaaaaaaaaaaagaaaaaaaaaaaaaaaaaagaatttcctcaatgttttcttctagtggtttcaaagtttcaggtcttacatttaagttttaaatctattttgttttaatttatatatatcttgagagttagggggtctagttccattcttctgtatatacaggatataattttctgagcaccatttattgagagactattcttgccccagtgtatgttcttggcaccttctttgaaaatgagttgtttataagtgtgtgggtttatttctggcctctctattctattggactatttgtctttatgccagtatcatgctgttttgtttgctgtatagctgtataccataattcgaagtcaggtaatatgctgcctctagctttgttctttttggtcaagattgctttggctattctgagccttttatggttcaatatgaattttaggatttttttttccatttctgagaagaatgtcattggtattttgataaggagtgcatttaatctgtagatacctttgggttgtatggatattttaacaatatttgttcttccaacttatgaacatgatatatattttcttttttgtgtccttttcaatttctttcatcagtgttttatagttttaattatacagagcttttactactttgattccatttattttatttgtagctattttaaatgggattactttttgatttttcagattgttctctgttgccatacagaaatgctactgaatttatatgtcaattttgtatcctgcaggtctactgaatttatttattagttctaataggtttttggtggagtctttaggttttttgaagtataagatcatatcatctgtaaacaaggataattttactttctcctttcctgtttggatgctctttatttctttcttttgcctaattactctgggtgggacttccagtactatgtctaataaaagtggtgaaagtgggcgtctttgttgtattccagatcttagaggaaaggctttcagtgtttccctagtcagtatgatgccagtggtgggattgttttatatgacctttattgttttgagttatatttcttgtatccctagttttttgagagtttttttttaaatcattaagggacgttgaatttcattgaatgctttttcaaccattgaaataatttttgacctttattttgttatatgttatagcaaatatgctatattttgttaaatgcgctatgatgtatcacatttatcgatttgtatgttgaactatcttgcacccctgagatgaatcttacttcattacgatgaatgatctttttaatatgttgttgaaatcagtttgctgaattttgttacagatttttgcatcttgttcatgagtgatattggcctgtagttttcttttcttgtgttttgttttgttttgttttgttttgtttgtgtttttgtttttaattgtgtctttgtctagttttggtatcaggataatgctggccagtaggatgaatttgagagtgttctctcatccttgactttgtagaatataataagtagaatttgttagttcttctgtaaatgatttgtagaattcagcagtgaaactatctgatattgggcttttctttgatgggagtctttattattgtttctgtttcataacttgctattggtctgtttagtttttctgtttcttcatggttcaattttggtagtttgtatgtatttaggaatttatacttgtctcccaggctttacaatttattgggatatagttgcttatcatagtctctaatgattctttgaattcctgtggtatcaattgtagtgtctttttttcatttcttaattatgttcatcttctcactttttttcttagtgtagctaaaagtttataaattttagttattttttcccaaataacttctccttttgttgatcttttatatatattttttagtctataacttattcatttgtgctctagtctttattagttcttctcttctcctaagtttgggtttagtttgttctgcttttttattttctaagatgcactattaagtgttcttatttgaaatcttttttgatgtaggcaacattgtttttgtggtgtcccataggttttggtatgttgtgattctatttttatttgtttcaagccattttaaagttttattcttaatttcttaattgaaatttaatgttttcattccttcagcagcgtattgtttcatttccatatatttgtatagtttccaaagtgtcattattcatttctagttaattccactgttgttagaaaaaatacttgatactctctttgggaggccgaggcagctggatcacctgaggttgggagttcaagactagcctgatcaaaatggagaaaccctgtctgtactaaaaatacaaaaaaattagctgagggtggtggcacatgcctgtagtcccagctactcgggaggctgaggcaggagaatcacttaaacctgggaggtggaggttgtggtgagccgagattgtggtgccattgcactccagcctgggcaacaagagcaaaactctgtctttaaaaaaacaacaacaacaaaaaccaacttgatattattttgacatgtaatactttgttgagactatcttcctggcctaagagatggtctgtcctcaagaatattccatgtgctaatgagaagaatgtatatttttcacccgttgaatgaaatgttctcttattgatcattaggtccatctggtctgtagtgcatattaagtctaatggtgcattgttgattttctatttaaaatatatgttcagtgttgaaagtgggtgttgaagtccccaggcattattatattggagtctgtctttctctttaggtctagtaatgtttgctttatattatctggatgctccagtgttttgtgcaagaaatatttgcaattttaatattctttggctgaatttgaccattttattattatataatgaccttctttgactcttcttacagtttttgccttgaaatctattttatctgacataggtatagctattcttgttttttgtttccatttgcatggaatatttcatttcatttccttcatttttagtgtatgttgtttttatagctaaagtaaatttcttatgggcagcatatatttgagtcttgttttaatccattcagccactctctgtcttttatttgaagaatttagtccatttacattcagtgttattgttgaaaggttaggacttaactacttccagtttgtcatttttcttctgattgttttgtacattttctcttcctttcttcctctcttcctttttagattagtgatttcctctggctgtatgttttaattccttgctttttattttttcaatttctattataggtgtttgctttgtcattactgtgaggcttgcaaaaatattttatagctaacaacgttaaattgataaaaactctaatctcaaagaagagggaacaaaaggaaaacaagcaaagaaaaaactaaaaaattctgtactctaacttttcctctaactccctcctactttttgactttttgttgtctctatatcttttcatattgtctatctttcaaaaattgttgtagttattatttttgatagatttttcttttggtcctcatgctgaaaatgtaagtgatttacacaccacaattgttgcactagagcaagcttgtctaacccgcagcttgtgggccacatgcagcccaggacagctttgaatatggcccaacacaaatcagtaaactttcttaaaacattataatttttttttagctcatccactatcattagtgatagtgtgttttatacgtggcccatgacaattcttcttctaatgttggactcttctgttagagtattctgaatttgtctttgttcttaccttttccactgaatttcatgctttcagatgttttcttgttatatgttagcagcctttactttcagattgataaaatctcttcagcatttttttttgtaaaatctcttcagcattcatctggtgatgatgaatttactcagcttttgtttgtctgggaaagtctttatttctcctccatattgaaggatatctttcctgtatgcagtattctaggttggaagttttttccctttagcacttttaatatgctatcttgctcattctggtctataaactccccactgagaaggctgctgccagaaatatcagagctcctttatatgttatttacttttttcttcttgttgcttctaggatgattctttcatctttgacctttgatagtttgattattatatgtcttgtggtagtcttatttcagttgaatcttcttgatgttctttcaccttctttacctaaatgttcgtatctttttctaggtttgaaaagttctcttattactttctttgaataaactttctaccccggtctttttctttgtatcctctttaagaccagtgactcttagattttcccttttgaggctcttttttagatcctgtaatcatattttattcttttttattcttttaaatctattttcatatagtatgtcttgaactaaatatttccgtttttgcttgatcaattttgtttttgagagattctgatgaatttttcagtcagttgactttttcagctcgagtgattttttattgtttatttcagtgtctttgttaaatttctctgttttatcttgaaatgcatcatgttttctcaaaacaggtgtattgaattctttgtctgagaatatatgtatctgccactctagaattggtcatgggtgcctcatttactccgtgtgatgaggtaatgttttcctgaatgctcttgatgcttgtggacatttgatgatatatgagcgttaaaaatttaggtatttgttccagtctttccagtctggcattgtttatacctgtccttgagaaagttttctgagaattcaaatgggattgagtgttaaattacttatttctgtggtccttgcagttgttttagcactagagggagccctaagcccaggtatgctgtactcttgcagactctaggtacatagcctgggtagacttctgaaagtgaagggagaattccttttgttatcaggcaaagtccctttctgtcttttccagaagcataaggagcccttctctaccctgaactgtctggagttggggaacgggtggcatgggcactttttatgtacatatttgtttatccaattatttgtaaaacaaaagatgtactataagaaaaatatgtcttcaaatcatgaaatatacagacattaaaaaaaattccaatcctatataactaatagtttcctccatttaggtcttactcttttgggttaagtttattgcaaggtgcttaatgggttttgttggtattatgaatacatttttttcctttaatattacatttgtaattggtaatgtctgtttttatatctgttatgtttttagttcattttgttgatctttttataggtttttgaatagtaggcttatctgattttcttaatttctctctatattttaagtttttaacagtgataaactttaatttttcagttttggggaaaaaagagttctttcaacataatgacagttctatttttaccttatgtttctctttttggcatactgtgactatctgttcatagcagacttttacagacgtgtttaatactttaatacacacactaggatgtgacccaaacattctctgagactcaagggtagtaaaaaggaagatgaattacctttttttctctcttctaagatgaggaaatttttcattttaaaccattctcacacattgtagattattcagagaagcagaaaatttattaccaaatgaggttgagcatttcttaaaataagtgtaggaagcttaattctctcaaactaggaacattgaaaaatctcaagctgcagatacatgaaaatagcttgagatggaaatattggttctatttattcttttgacacaacaatgttaaaagtttgtattctctcagtacatactacgttctgtgttgcacaggaaagccaacttgagattttgaatattccaaagagaggccatccttttgagctgttttcattctttttgttttcataaaaggaatttcaaaggtgaggagaactgaggctatgaaaactgtttggccctgatgtcagatattttagcatgccttcattatgggttactggaatatgcagtttattacttatttctgttagatgcttttaaaaagaactatctgtgggctaattcccaaagttcccctggggaactttgccatggctttatcaaacctactcccttcctcaggatctcttcttctaatttttatttgtacaaagttttatgttctacctcttcaaactttgactaagcattacttcaacttttgctatttgaatagtgatttttaggcccttagatctgatgttatagaatatcttcacctctggtttacaagtttttgacaatgaagtgtgtcatttacttgctttcttttcaggaacaagtggactaatatatctctatgtaattttgaaaactattcaatagtttcagttctgtaggtagaatactatttatttggggccagagagaaactattattttgtctaagggttcaatatttctctttaattttatttgatgtgatgcttagcccctataatgtattgcttgaggtttgcattacaagaatatggcactatttggttttttaaaaagtgatataagatgttatgattgaacttaataataaaaatggttcttatgccaactcacaagtgttgtagaattcctactggcttgaaatgacaggcctagggtgaagaaaagataaatttaaagtggggcatagttctacttatattctaatacgtataaaacatttatttagtacagttcagaagattataggttaacctaagaaactttaaacatacttttggttttattctgatatttgtacaattttttcaaaaggcaaaaccaaactaaattccaatttggacacacacttttgcattgctcaaatagtgcatgaatactaattagtgatggtggagaagttaattatattttagtcatgcctacagcaggtgtaggaaagcttcagcataaatattgtttataaatatttcataaacacattaaaatcctccttaatatattatttaggaagaagtgcctttctctcaaagacccatttttatatgccataggacatggatccaaatatttacttttctcttagttacacatacttttatctatatcttttatcttacctttactttatggccaatttattgattttatagtaataatttatgtttttaggctttaaaggaagtatataaacatttaattatatatttgcttaacagtacagcctattttattaggcaatttaaaatttttaactttctgctgaacatttccaaagtcccactactatacaaattaattagttaagaaatggaattcattgtcgttattattttaaatatattctctctccatccctatcttagttaatgatactatcactcttttaggctcaatttcaaaagcatcttcttattccatcttttccctctgccagtatattcaattccaaactgatcctggctctgcactatctatgatatttattcccttcttggagttcattgcccttattagtttaggcctccatgatcctgcttctcttgtgttcttgttagatgttacagattacctgacatgatataagttctcattaaatatttgttgaattaatgcatgaatgctctcactatgtatttatagactctctccatttacaatccacctttatacttccttcataggaaaagaaaaaagagacaattttcttcctaaaatcattcaaaaaacttattttgttactatttctaaaatatttgttgcctgcaaattatctatgaagtacatttaaagctcctttataaggcttgtaaatccttttatactgagcccagataacttttcttgctttacgtcttaccatatttttcatattctatcatatctttatttttttattttttgcaatttacattttactcaataatacattttccttgtcagttaagctccaagcattatatctaaaaatgtggataatgtttattgattataccaggtacattgctaaaaagctaatctaaatgtttttcgattaattctaagcatttaataaagattttagtatacctattttagttattatttattatacctattttacaaatgagtaaaccaaggacataagcctaactcctttttgaaaggttaagtcattaagtgctagaatgagaattgaaaccttgaactacctgattctaacagtggtctaaaccagtatgttcttatattttctttgactctcacatgcaactagtggccagctcttatccattttaaggccataatattgcacatccattgtcctacttatgtctattattatttagccttgactgttacattagcttctaaacagatcttttaatcagtattttattcagtttccaagacttccacaatattatatagtttttacttcatatccaaccactcctccctataaacccaggtctttgcctatttaaatgggtgttatgtccctgcctttgaactcaaattactcatttttcaaatctcagctccaataaaattccagcctaaaaacttgtcataatatccccactaacttcaggcaggtttgtgcctccatgattattaccatcagtgttcttgttaagtcataatttacttgtctttttatctagcaggatgtgaacatctttatgagagaatttttgtctcatatgttttgtagttttttacattcttgtatgctcactattaggtagtactgtacttggtacatagttagaattttgctgtattaatattactacaaagtaacatttgtttcatctgttttaatcatttttatattatcgaaaagaaaatattatttagtcttcctagcaaacgagttttctagtttcaactaatttttactttacaggaagaggcaaaaagtagcttcctgtttttaaaattattgattattctgcttgcttttattttcagcaattgggccaacagtgaaataacactggcagttccaatgtatgtattatatttgctctgaatgagaattggttttaattattatagatgatttcccattctcataactcttattgagcaataatgcaatattttatatataaattttttcattgaagactggtaagagaagttatgtaaagctcaaataaggaagaaaatgcaatttatgtaactctcttcagtttctagtttttctagagaagataaatagaatcttgatatctgacttttcagagcttaactatcttacattttgactcactaacctattaattctggagtcattttagcagaatgtattattctatacaataagttactagataacttcaaagtactaatatttcactttaccataacatatgtattttatgtgatttttaacatacattttgtgcattcttctagctgtaagcgtccaacttctggaatttcaaagtagtataagactatgtaactcccattatttgtaacagaagatatttgagtaattattcacatatgatattttatatattttaaaaattaagcactagtgttttcttgacaaatggaataatcgtttatttcatatattcctaacaacatcccaatacccaaaaagaaaaaaataactacccttaatatatgtaggaaaaacaaagaactcttcaaataaagttgttacacataatgttattattgatttacaagtcaaaagaataaaaatgcattttattgtctatttctaagtgtagaaatgtttagtatttataaaatggaaaagttctatttaatttgtttgttttgacataagtccatgtgaaagagctataaagaaaatacaaacagttcccccaaattgcctttctctcttcatggctttcagttaaacattgtaaacttaaggtctctttaccccttaaatactttagtgcatatttcttaaaaactaggaattctcttaaccacagtataattattgaaatcagaaacttaacattgatgcatattgttattaaatatagattttattcagattgtgccaattgtctcaatgttgttttttaaagcaaaaaaaaaatccgattattagttgtgttcatttttgaggccttcttagtcttttttttttaaaaaaaaatttattttactttaagttccagatacatttgcagaatgtggaggaggtttgttacataggtaaacgtgtgccatggtggattcctgcacctgtcttagtctttaacctgggtaatttcccaactctttcattttgtttaatgtcatttgacattttttaggactacactatattatttttgtgtatggatagaatgtgctacaatttgtgtttgctatgtcttcatgattatgttctgattatgcacttttggcaggaatacctctgaagttatgttaaattcttaccaacgtatcaggagccacatgctgtcatcatgctcttaatagggatgctcacaatgaacctttggttacagtggtgtctgccagacttcatcactgtaaaggtgctattttatcctttacaatgaatgagaatcttatgggagatactttgagactatgtgcatgttgtgttagtcctcagtctttcacccgctagttctaacatatattgatagttcttctgtaatcaatgattattatgatttttaccaaatggtgattttctaatttctttattctttccacattgattagttggctttctactataatgagaagcttgcttttctctcttttgtctacctgtctatgtatgtatgtatgtatgtgtgtaatcctttcattctttgagcatttccttatagtttcggcatttatcttgtacttttccagccataactgtggaagctagcatttatcaagcagctttggtacttttagtgggctctgagcatcattgtttgtggatcacctcagcagacaaactagagaatacatgtatgtgtacagaaatgcttacataggtgtctactcacagacacatgtattttcatacatatgcacaacctcacctacatcaatattcatttcttccttcttcacaatcctttaaaaatgcaataacattcttagcttgagaatcatagaaaaattggacatgggctggatttggaccccatatcatagtttagtgacccttagaatatatggtttgagtttcctctcattttttaatgtggtatacaatgttggactgtaaaatgtaaattttatagcactcttggccctttgagtctccaatttataacttaaatttttgaaacagtgctattttctggaagattccagttacttaaggtttaaattattgtttatgatcatgttcacgtactggagcactgctttgaaaacattcagtaagtactggatcaaagaatgaattactttaccttttttatcgaagaaagaatcatttcttgttttcccactctttaatataggcaagtacaggtgcctaatatcctaaataaacaaagtaatctgattaagtcatatggccttttctaaattgcaagagctatcatgtatccaaaagaaaaaaaaatttacacttctcataacagcaggttaatatatggcaatggttgtaaatctagggcttttttgtgagaaaaatcagatagtgaagatattgatatcagcatttcatatttatttatataaaaaagaaacagctatattgttttcctttttcataaactataaattgatgaaaatttgggcttagagctataaataaaaatgtaagttaaaaaatagaatgaaaatttatttttcatatttttaattgaccagtgaaaattatgtatatttataatatacaacatcatgtttggtttatgaggatatattgtggaatgcttaaattaacttaacatatttatcacctaacatacttatgattttttgttatgagaacatttaaaatctgctcagcggtttacaagtatgcagtacattgtttttttttttttattatactttaagttttagggtacatgtgcacattgtgcaggttagttacatatgtatacatgtgccatgctggtgtgctgcacccactaactcgtcatctagcattaggtatatctcccaatgctatccctcccacctcctcccaccccaccacagtccccagagtgtgatattccccttcctgtgtccatgtgatctcattgttcaattcccaccaatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaaatggtgtgagatggtatctcattgtggttttgatttgcatttctctggtcagtgatgatgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaagtctttagtccatcttcaattgatttttgtataaggtgtaaggaagggatccagtttcagctttctacatatggctagccagttttcccagaaccatttagtaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttattcttttggcttaggattgacttggtgatgcgggctcttttttgattccatatgaactttaaagtagttttttccaattctgtgaagaaagtcattggtagcttgatggggatggcattgaatctgtaaattaccttgggcagtatgggcattttcacgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatatcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagttattgcccattcagtatgatattggctgtgggtttgtcatagatagctcttattattttgagatacatcccatcaatacctaatttattgagagtttttatcatgaagggttgttgaattttgtcaaaggctttttctgcatctattgagataataatgtggtttgtgtctttggctctgtttatatgctggattacatttattgatttgcgtatattgaaccagccttgcatcccagggatgaagcccacttgatcatggtggataagctttttgatgtgctgctggattcagtttgccagtattttattgaggatttttgcatcaaggttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactactgagtattgccacaatttcagctcccgttattggtctattcagagattcaaattcttcctggtttagtcttgggagagtgtatgtatcgaggaatttatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatgaattttgttgatcctttcaaaaaaccagctcctggattcattaattttttgaagggttttttgtgtctctatttccttcaattctgctctgattttagttatttcttgccttctgctagctttagaatgtgtttgcccttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacagctttatttctgccttcatttcgttatgtatccagtagtcattcaggagcaggttgttcagtttccatgtagttgagcgattttgagtgagattcttaatcctgagttctagtttgattgcactgtggtctgagagatagtttgttataatctctgttcttttacatttgctgaggagagctttacttccaagtatgtggtcaattttagaataggtgtggtgtggtgctgaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctgagtctctttgtaggtcactcaggacttgctttatgaatctaggtgctcctgtattgggtgcatatatatttaggatagttagctcttcttgttgaattgatccctttaccattatgtaatggccttctttgtctcttttgatctttgttggtttaaagtctgttttgtcagagactaggattgcaacccctgcctttttttgttttccatttgcttggtagatcttcctccatccttttattttgagcctatgtgtgtctctacacgtgagatgggtttcctgaatacagcacactgatgggtcttgactctttatccaatttgccagtctgtgtcttttaattggagcgtttagtccatttacatttaaacttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatcggttagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgatcgttggcctgccttgctagattggggaagttctcctggatgatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttccagttgatcgcatcagctcctgaggcttctgcattcttcacgtagttctcgagccttggttttcagctccatcagctcctttaagcacttctccgtattggttattctagttatacattcttctaaatttttttcaaagttttcaacttctttgcctttggtttgaatgtcctcccatagctcagagtaatttgatcatctgaagccttcttctctcagctcgtcaaagtcattctccatccagctttgttccgttgctggtgaggaactgcgtccctttggaggaggagaggaactctgccttttagagtttccagtttttctgttctgttttttccccatctttgtggttttatctacttttggtcgtcgatgatggtgatgtacatatgggtttttggtgtggatgtcctttctgtttgttagttttccttctaacagacaggaccctcagctgcaggtctgttggaataccctgctgtgtgaggtgtcaagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcagttggagctccctggctgctttgtttacctaagcaagcctgggcaatggcgggcgcccctcccccaggctcgctgctgccttacagtttgatctcagactgctgtgctagcaatcagcgagactccgtgggcgtaggaccctctgagccaggtgcgggatataatctcgcggtgcgccgttttttaagccggtccgaaaagcgcaatattcgggtgggagtgacccgattttccaggtgcgtccgtcacccctttctttgactcggaaagggaactccctgacccttgcgcttcccaagtgaggcaaagcctcgccctgcttcggctcgcgcacggtgcacgcacccactgacctgcacccactgtatggcactccctagtgagatgaacccagtacctcagatggaaatgcagaaatcacccgtcttctgcgtcgctcacgctgggagctgtagaccagagctgttcctattcggccatcttggctcgcagtacattgtttttagctacagtcaccatggctgtagatctccagaaattattcttcctttctaacaaaaactttgtacattttgaccatctcctcatttcccatccccttttccacaccagctcctggtaaacatcattctaactctctgcttttgtatattcgattctatttttttttttttttgaggtgaattctcgctcttccgcccaggctggaatgcagtggtgtgatcttggttcactgcaaccaccgcctcctgggttcaagtgattctcctgcctgagcctcctgagtagctgagattacaggtgcccaccaccacgcctggctaatttttgtatatttagtagagacggggtttcaccatgttggtaaagctggtcttgaactcctgacctcaggtgatctgcctgccttggcctcccaaagtgctgggattacatgcataagccactgcgcccagccgtaaatttgagattttagatactgcatacgagtgaaatcatacagtattagtctttttttaacctggcttattttcacataaaataatatcctctaggttaatccatgttgttgtaaaacaccggatttgcttatttttaaggctgaataatatttcatttttaaatatatatattataaatactatgtatataatgtggagaaaatatgggggatggaggattctgtgatgaggataggggttgtgtgagggggatggggtaattctttgaaggggattggggttctgtgagggggaagggggttccatgaggggatgggggttctgtgaaggggataggattctgtgaaggcgatgggattccgtgagagggatgagggattctgtgagcgggattggggttttgtgagaggatgaggcttgaatgagttgatcacttttgtgtagtattcatccattgatggatatttaagttgattttgtatctttgctagtgtgaatactgctgcagtaaacatggggagtgcatatatctctttgaaaattgatttcattttccttggatatatatacacagtagtgggatttttggatcatatgaaaggtccattttcagttttctgagtaaactgcatactacattccataatggccttattaatttacattccccccaacaatgtacaaaggttccctttttttccacatcctctctaactcttgttatcttttgtcttcctgataacagccattctaacagatgtgaggtggtatctcactatggttttaatttgctattccctgatgataaatgatgtggaatatcttttcctatatttattgaccattttttaatcttttgagaagtgtcttttcatgtcctgatatggtttggccatgtccccacccaaatctcatcttgaattggagctgctgtaattgccaggtgttgtgggagggatctggtagaagataattgaatcacaggggtggatctttcccatgctattcttgtcatagtgaataagtctcccaagatctgatggttttataaaggggagtttccctgcacaaaatcttttatcttgtctgccaccatgtgagatgtgcctttcacattctgccatgattgtgaggcctccccagccatgtggaactgtaagtccattaaacctctttcttttataaattgcccagtctcagtatgtctttatcggctgtgtcaaaatggactaatacagtaaattagtaccagtagagtggggcacttctgaaaagatacctgaaaatgtggaagcaactttggaactggttacaggccaaggttggaacagtttggagggctcagaagaagacagggaaatgtgggaaagtgtggaactccctagagacttgttgaatggctttgactaaaatgctgataatgatatggacaatgaaatccaggctgaggtggtctcagatggagatgaggaacttgttgggaactggagcagaagtgactcttgttacgttttagcaaagagactggcggcattttgcccttgccctagagatttgtggaactttgaacttgagagagatgatttagggtatctggtggaagaaatttctaagcagcaaagaattcaagaagtgacttgggtgctattaaaggcattcagttttaaaagggaaacagcataaaagtttggaaaatgtgcagcctgacaatatgatagaaaagaacatcccatttttctgaggagaaattcaagccagctgcagaaatttgcataagtaatgaggagctgaatgctaatcaccaagacagtggggggaaatgtctccagggcatgtcagggaactttctggcaggctttccaaccacaggccaggaggcctaggaggaaaacattttttgtaggccaggcccagggtccctctgctgtgtccagtctagggacttggttccctgcatcctagccgctccagccatgaataaaaggggccaaggtacagcttgggccatgggttcagagagtgcaagccccaagctgtggcaactttcatgtggtattgagcctgtgggtacacagaagtcaagaattgaggtttgggaacctcttcctggatttcagaggatgtatagaaatgcctggatgtccaggcagaagttcacttcaggggtggggcactcatggagaacctctgctggggcagtgcagaagggaattgtggggtggtacccccacacagagtccccactaggtgtgatgcctagtggagctgtgagaagagccaccatcctccagaccccagaatggtagattcaccaacagctggcaccctgcatttggaaaagccacagacactcaatgctggcctgtgaaagcagccaggagggaagctgtaccctgtaaagccacaggagcagagctgctcaagaccatgggaacacacctcttgcatcagcgtaacctggatgtgagacatggagtcaaaggagatcattttggagctttaaaatttgactgtcttgctggattttggagttacatggggcctgtagcccctttgttttggccaatttatccaatttggaacaactatatttaccgaatgcctgtacccccattgtatctaggaagtaactaacttacttttgattttacagtctcatagacagaagggactctccttgtctcggatgagactgtggacttttcagttaatgctgaaatgagttatgacttgggggaatgttgggaagacatgattggttttggaatgtgaagacatttgatttggtaggggccaggggcagaatgttatggtttggctgtgtccccacccaagtctcatcttgaattgtagcccccgtaattcccatgtgttgtggaaaggacctggtgggagatagtggaatcatggggacaggtcctttccatgctatttgagatagtgaataagtctcacgagatctgatggtttgaaaaaggggagtttctctgcacaagctctcttcttttgtctgttgccatgtgagacatacctttcaccttctgccgtgattgtgtggcctccccagccatgtggaactgtgagtccattaaacctctttcttttgtaaattgctcccagtcttgagtatgtctttatcagtagcgtggaaacggactaatacatgttctttgtccattttaaaaatcaggttacttgttttcttgctattgagttgtttgagttccttttatattttttgatattaacccctcatccaggtatatgatttgaaaatattttctgcaatttcctaagcgtatcttcactgtgtggattgcttctttggctctgcagaagcttcttaattggaaacaatcccatttgtctatattttttttgtctatttttaagctttaattatctgtgcttttgggaccatgttcaaaatatttttgccaagagtaatgtcaagaaggcttcctatgtttttctctaagaattttcagggattacctttaagtcgttaatccattttgaggttatttttgaatatggtataagataaaatttcattttcattcttatgcatgtaaatatccagtgttcctaacagtagtcattgaagaggctatcctttccttattgtgtgttcttgccacctttgttgaagatcaatagactctatggttatggatttatttccagtctttctattttatttcatcaatcatatgtctgcttttgtgctggtatcatggtgttctgattactatggctttgtagtttattttgagataagatagtgtgatgcctccagcttcgttctttttgctcattattgctatggctatatgagctattttgtggttccataattttagggttgtgttttctgtttctgctaaaatgccattggcattttgatagggattgcattataccagtagatcactttgcgtaatatggacatcctgagaaaatgaattcttttagtccatgaatacaggatattgttccatttatttgtgtcctgttcaacttttttcatcaatgttttataattttcagtatataggtcattcacttctttgattaaatttattcctaagtattttatttttcatagctattataaatgagattatttcttgattttgtttttagatagttcactgttagtgtatagaaatgctgctgatttttgtatgttcattttgtatcctggaacattcatgaatttgtttgttatttctaatgggtttttggtggagtctttgcagttttctgtaagaacttgtcatctgcaaacagggacaattttacttatttctttaaaatttggatagcttttatttctttctcttttctaatttttgtggctaggacttccagtattatgttgaatagaagtggtgagtgtcggaaaccttgtcttatttattgttctagaagaaatgcttttgacttttcactaatgagtatgatgttagccatgggtttttatctaacttctttattatgttgaagtacattcaatacttaatttgttgagcattttttcaatcatggaagaatgttgtattctgtcaaatagttgttctacatctactgatattacgtgatttttatttttcattctcttaatgtagtatataacagttgttgatctacatatgttggaccattcttgcatccctaggataaatcttacttgatcttgatgaatgattttttttcattaaaggattattgaaatgattgagtttgtttcataatattttgttgatttttttcatctatgtttattagagatattgactggtaatttcttttatcttagtgttcttttctggctttagggttagggtaatgctggccatataaaaatgagtttggaaacatttcctattttaatgtttttggaaaagtttcagaagcattaatatttattcttctttaaacatttggcagaattcagcagggaagccatcaggatctgagcttttctttgatggtagacttttcaatatttatttaatcttctaaattgtttgattctgtttatattttctatttcttcatgattcagttttggtagattgtatgtttctagaaacttactcatttcttataagtgattctatttgttgatataaaattgtgcatagtagtctcataatcttctatgatattagttgtaacacttctttaattttctttatatgaatcttttttgtgttttcttagtttagttaatggtttgtcaattttgtttatcttttcaaaggaaaaaactcttagtttcattgatcttttttatttttttctagttcctatttcatttatttatttatttattttgctgtgatttttattatttctgcctcccttctgctcactttggactcaactttcttttccttctcattctccttctccttctccttccttcctttccttccttccttccttccttccttccttccttctttccttcctttcttcctccttcttccttctttctttttttctttctttctctttcttcttctttgtttcttgagatctaaagttaggctgtttatttgagaacgttcttcttttttgaagtaaccattaattgcataaattttcctattagtattgttttgttcaacccataacttttggtaggttgtgattccatgtttatttttgtcaagacatatttaagtttctcatttgaattattctttttgtttaggaacagatagtttaatttccacatctttgtgaattttcaatttttcctcctgttactgatttctaatttactaccattgtggttggcaaagatgcttgatatgatttcagtcttcttgaatttttaagacttgttttgtggtctagcatattatctatcctgaagaaagttccttgtgtgtttgagaagaatgtgtatgctgttgttgttgaatggaatgttttttatatgtcttttaggttcattgatataaagtgtaggtcaaatccaatgttgttttttttttaatagacattttatctggatgatctgttcaatgttgaaagcaagggtattcaagtcccttactattattttattgtagtctatctgtcttttcagatctattaatattttctttatatatataggtactctgattttggtgcatatatatttataattgttatatccatttaatgatttgatcttgtttttattacctaatgaccttctttttgtctactgatacattagattaaggtctgttttgtctgatatagccacccctgatctcatttggttattctttgcatggaatatcattttccatcccttcactttctatgtatgcctttaatattaaagtttgtctcttatagggagtctattgtttgatcactaaaaaaagtccagttagctaatctgtgtctttttatttgaaaatttaatccatgtaagtttaaagtaattactgataaatatttaatcttgctattttgttaattgtttggtgattgttttgtagttcttttgtttctttcctccaaccttgctttttactttgtgttttgttgtatttttatagtggtatgctctcattcttttttctttatcttttgtgcatgtactagaggtttttatttcatgattaccattaagcataaaatataatattctgatttaagctaataataacttgaatttaatcacctacaaaaactatgctttttcacctttccattacattttatgtaattgatgtcaacttattttttatattgtttttagaaaatgtattatgactatagatacttcattacttttttcttttaaattttatactacagctaaaagtgatttatataccactgttactgtattactgtattctgaatttgactatagatttacatttactagtgagttttatattttcatatttttaatgttgttacttatcatactttcatttcaaattgaagaatttcctttagtatttattgtaaatcaggtcaagtggtggtggactctcttagctttttgtgtgtcttgaaatgtgtttctctctatttcacttctgaaggacacctttgctgatgtaaaagtcttggtggtgtttttttcctgtaagcaatttgaatacatcatccttcttcctcctgttttataaggttgttgttttttttaaagggggtagggatttccattaatagcctaatggagattccttgatatgtgatgattctgttatctcttactgctgaagattctctgcctttgactttatttatttatttatttttgagacaggatcttgctttgttgcccaggctagagtgcagtggtgtgatcatagctcattgtaacttcaaattctaggtcaagcaatcctcctgccttggcctccccaagtagctaggactacagatgcatgctaccacatccagttaatttttttagtttttgaagatatggggtctggtagctaggactacggatgcatgctaccacatccagttaatttttttagtttttgaagatatggggtctcgctatgttgcccagactgatcttgaactcctggtctcaagtgatccttctgcctcagcctttcaaagtgctgtgattataggcatgaaccacccagtcctgtttttgacttttgacaattttattatattttgtcacagagtattttttggattcatcttacttgagatttttttaagtttggaaatctggatgtctgtaaccttcccaatatttgggaagttttcagccagtatttctataagtaaactttttctccctttgtcacatcttctggtgatcccataattcatatgtttttatgtttgatggtgtcacatagattccttatgctttcttcattttaaaaagaatcattttttgtttttctaactggttaatttcaaatgatctatctctgagtttgctaatttttttcttgtgtatgattgagtctgctgtttaaactctctattgtgattttcatttctgtcatattttgtagctcttggatttctattttgttctttttattgtttacattttcttattaagcttctcattttgttcatgcattatttttataattttatttaattgttggtatggtttggctgtgtccctacccaaatctcatcttaaattgtagctcccataatttctcatgttgtgggagggacccagtgggagataactgaatcacgacggcagtttttcccatactgttcttgtggtagtgaataagtctcacgaggtctgatggtaccccattcacttggctctccttctgtcttgctgacaccttgtaaaaagtgccattcaccttccaccatgataatgaggcctcccccgccatgtggaactgtaagtccattaaacctattcttcttcgcagtcttgggtatgtctttatcagcagtgtgaaaatggactaatacggttgtctatctatgtttccttgcatctcataaagcatctttagcatcattattttgaattctttttcaggcaatttgtatttctccacttttgggcgttagttactggagcttttgtggtatcatatttttctgactttttcttaactatatagccttgcaccagtatctgtgcagctgaggagcaaacacctcttccagtccttacaaaatttgacagtctgtatatgtctttataagtccttctcctgttgggtccttgggctgatggaattgcctctgaaattatggttgaatggaattggagttggctcatgtggctgatgctgtttctgtggtagggtctgaagatgatgacactgctactggggctctagcaagtatgaattctctccatttcctaggtggactgcactctctccaggaccttggttggtagggcttacactgagatgagggttcagagttaacagacatttggtctgtggccacatatatggactactgtggcttcttctgcattcttgtaagggctgccactggatttctgggtgggtcctttagcagacagacagcacttccctggtctgtatccgagatggactgggactgagtcacagagctgcttcagggtctacacctgaggccaaggtcttcatatctgtctctgggatatcatacgtgtgtgtttactagcacgttctttggtgggtacacctgctctcagattgtagttgacaggggatacaactgatttatagggctgtttcaagatccacagtgggactaatgtcagcaggttagcctgtaggggcagtaacagacacgcccatctgtaggtccctgggaaggcagaactgatttcaggctgcagtcaagatgagccaggcccaagatccagggccatttcaggttctactgtggaactaaagttgataagcctgtcctggggactcagatgggcttgtttcccagtggtgccctgactaggcagaactgttttacaactgtaaataagagatactgggaccaagatccaaggctgtaccaggatgtgctgttggactgagtctgacaagcttctcacagtggcagaggagttagtctcccagcagttccctgtgtgtgtgtgattgtttctaggccacagcagagaggggctggagctgagattggggacctgttcaggatctgctttgggataagaccaacaagcctgtcacagtggcacagatcagcaagtctcccagtgtttttgaagcatagaattttaaattatagggtatttgaacttttgtctttgttagaattcttactatatttgaaatctaatctataacatatctattaaatttctttaagtataattatgctgtaaggatacaaagaaaattaaatttacatgatatcctaacctctaggggttgttacaagtatatgacagttgatgatgatgcaagcaaggaaataatgatatagcaagggatgggcataggaacataaactgattttgaagcaggtactaccattggctactctttggttttatgtttctaaagtgtttttttttataaacaacttctttcaataactttttttgcatctttttttatccttattgtttggttttgcttataagttgatactgcaactttatattctagggggcagaaatatgttggcctcattatgttcctttagtgtatatctagaatataaaatcatcatcatatataaaattttaaacaaaggccactgtataatgccttcataggtgctggttcagcataaaaggatagccacaaatgctgacaacaacagaataatttcagcactgtcatgaagtataaattttaaacaattgaatttaaaatgcatttgtgctattttactctgaaatacagtgccacaagggaattctctcacaatgagctcacaaaaagttagcgtcttagaaattattgaatttactgtacaatggtaattcttttaagaaatgtggcaagcataactagtatccagttttgccataacagataaatgaaaggtttatccatattttaagatattaatatacatcgttttagtgtaactctgaatatgacagtattaatatgaaactttgcagattaatattaaaagacatcatgatatattcattatttttgaagttacatattactaatatatcacggtgtgtctttactacttgatgacagtttcctttattccctgcagctctctgccttgtgtttcactctgtaattctcacatcttatgttcccacagctaattctacaaacttaatgaaaaaactgtgtaggtttatttaaatattctttatgaagtaaactttatacctttttttcttttgagacggagtcttgctctgtggcccaggctggaatgcagtggcgtgatctcagctcattgcaagctccacctcccgggttcacacccttctctcgcctcagcctccctagtagctgggactacgggtgcccaccaccatgcccagctaattttgtttttgtatttttagtagagacggggtttcaccctggtagccaggatggtctcgatctgctgactttgtgatccgcccgcctcagcctcccaaagtgctgggattacagtcgtgagccgccgcgcctggccaactttatatatacctttatgtaaaaatgtcttctagtagaaaaacaggttcttagaaacctttctagtaccaaaagtaattttatgtatgcatatggagatgtgtgtatttattttaatcatctgttttttcaaaggtaataatcataagcaattagcaagaaacttagtgttctacagtatttcataatacggcaagtactgatgatttttcaaacatctctgttaaaatataattcatacatttaaaaaattacaatttgaaagtatacaattcagttgtttttactgtattcaccgggtcatgcaaacataattataatctacctttaaaatgttttcatcacccccctctaaaaagccctcagtcattagcagccattccccttcctcccttgtcccccagccctgcctctggtagccctgggcaatcaataatctacttcctatttctataggttttattcttctggaaatttcatataagtgaaattatcaaatatgtgatctttcatgactgacttttttcatgtagtgtaataaaggttcatccatgttgtattatgtaccaggactgtactaatttttattgccagacaaaattcaattataatatccaattcaaatatggctatatcatattttgtttcttcgttagttgatggacttttgacctatttccattctttggctattatgaataatgctgctatgaacattccgtgtatgttttattgtggacatttaaaaaaatcctctttggtatatatttctagaagtagatttgctgggttatatgtaaattttatgtttaatattttcatggactaccaaattgtttccaagaatagctgcatcattatacatcttgaccagcagttcatgtgtgtttctatttctccatattccacaaactcttatcattatctgtcttttttgttatagccctcccagtatgtgtgaagtgatctcattggagttttgatttgcatttccctaaggagtaatgattttaaatatctttttctgtgcttatcagtcatttgtaaatctctttggaataatcttctttggaatattcagatatttttctggactttttttagttgggtatttatctttgttttttgtttatttttattattactattttttgagacagagtctcactctgtcgcccaggctggagtgcagtggcacaatctcgactcactgcaacttctgcctcccaggttcaagcaattctcctgcctcagcctcctgggtagctgggactacaggcacatgccaccatacctggcaatttttttttttttttttagtagacatggggtttcttcaccatgttggccaggctggtctcaaactcctgacctcaggtgatccgcccgtctcggccttccaaagtgctgggattacaggtgcaagtcaccgtgccaggccatgtttttattatttaatagaagagttctttatattctggatacaaataagaaatacaaattgcaaaaattttattccattctttattgtcctcttatttttttgatggtatcatttgtagcacaatatttttaaagactgatccagtccaatttatatttttgttttttgtgtgctcctagtactaaaacaattacctaactcaaggtcacaacgttttattcatacatttttctggagagctttataattttaactcttatatttaggtgtcttatgtattttgagtgatgtttagggcatggtctgatgtgtaggagtccaagtctattttttttaaacatgcatatctagttgtcctgccatcatttgttgaaatggctgttcttcccccatttacttattttggcacccttgacaagaatcaattggccataagtgtaatggtttatttttggactttcaattttcttccatttatacacaatttatatttataccagtattatgtagttttaatattgttgctttgtagtaatgtttgaaattgggatggctgagtctccaactttattcttcttttaaaaatgttttggctgtttgagactccttgtaattatatgtgtattttagaatcagcttgtcattttctacaaagaagacagctcagattctggtaaggattacatgaaatctatagagtaaatttatatatcatcttaccaatattaattcttcttatccatgaacatgggctgtctttcaatttatttataccatctttaatttttaaacattttataattttttacagtacatcttgtacttcttttattaaattatttcgtgagaattttattttaatactattttatatgaaattatttttttaatttcattttcacattgtttattgctagtgtatagaagcacaatagacttttatacattgattttatatcctgcttacacattgatttggtatccttgcttaattaatctattagttctaatagactttttgtggattatttaggctatccaagatcatgtcatatgtgagtcgtaatagcttcacttcttcctttccagtctggatacttttaattctgttctttgctttttttttttttttttaatagctacttggtttgataagaatctccagtacaagcataaaaataagtggcaagagcaggcatccatgtctcattcctgattgcagtgggagaaaagattctgttttttactgttaaacatgttagatgtgagtttttaaaaaaatgcccacactatttatcaagtacccgtatttgtgcacccttgtcaagagtcaattgtccataaatgtaatggtttgttttgggactcttaatttcattccattgatatgcattgtatatttatgccagtatcatgtgggtttaatagaaatagagaggaagttctttttatttctagttgagtatttttaatgatgaaagaacattggatttttcaaaataatttttctgtatttattcggttatttttgtttgtttttctttttttttttctctctctactggtctttttccttttagtgtggtacattgcatttactgatttttgtatgtgaaaccaactttattttcctaggataaagcccactggatcatggtgggaatctgttaatgtttgcctaaatttgctttgctaatattttgttgaagatttctgtaaagttggtagtgatgtctccctttcattcctgattaaaacatatgttttaaaaaatgataattatgaccgggtgagaaaatcttcatatctttgtgggtctgtatggtttgtgtctgtatgtaatttcagaaaagtaacatgcatgctagattaactatgtgtatagttagatatttgtatatgtgtataagacttgcagacattttcccttactgcgtttatgtttgtaagtttatatttataaaattgaatataatatcaatgaaaaatttccagttgtgctattggcataagattgatacctttccaaatcaagggtcccataagaaaattgcaaaattcagcatcgaatatatcatacttggtgctgcttccaaaaatatacaaatattcagaaatatattttaaattggatatgtgaggcacctatcacaaaatgtcatttataacaaattatgctactttacaaattaagataataaatatttgttgacaaaataaatgaagtaaagacagcatgatgtatgttcaaatactgtaaaatttagttaccttttccaaatacagactcagaaaaaatgcagttttgtttattttatgtaagttttactttctttgatgccctttaagtaattgcacttgagctgacttgatatcaactgagaagcaaggaaaatatcaaaaagtaacattatttaaaatatattattttgcgtttataaataggcacaatttaacagtacagatcttaaaattaaaattatttaattagtattatcttcatttcatatttgaaaaagtgtgagtttgtgtcattaaagcactaaaagatgcaaaacctatgcaaacaaatgaaagtaaatatattaacttttctcaattccctaccaaggaacatcatgttgtcataactatatgtattttatcttcatagaattagttataagtagtaaatgcatgttctttaaaagtgcccttagataaatgttgtcaaattctctatatccaagaaatcactaccacaatcaagataaacattttttttcaccccaaaagtttccactgtatctcctccccatcacttcctcacctgccccaaggtgcagccaaatactactttttaatttcttttggtcacaaatataagggtttttttttcttttaagaaaatattttatgctttatgggccattcggtctgtgtgcagcagctcaactctgcttctataaaatgaaagcagtcatgtatactatctaaacaaatgaatgtggctgtattccagtagaacttatttcatatacacttaaatttgaatttcatgaaattttcatgttatgcattttttcttcatttttttttcttcaaccattaaacattttaaaaatctaccctaagctcatgggtcatacaaaagtaaaagacaagctagatttggctcatgggctatagtttgatgatccttgctgcagactgtatttgttatttctaaagttttgcatacataaaattaaatagaactttcgtttctgatttctttcactcagcatttttaatttctctttttttttttgctgagtagtattttattgtctggatataccacattttgtttattccatcacacctggtttttttctagtttgtaaggagcaatattatttgttaatattgttacttacaatattagtgttaatatttatgtgtttatatttatgtgtaagtgtatgtgtgcatgtcttgcatttctcttgggtaaatactttagagtggaattgctttttgtgctatcataaatttgtaaacgtatgtgtcaccttataggaaattgtcaaactgtttttcaaagtaattgtatcattgcatatttctgtcagaaatttatgaggattttagtgtttcattttattgtcaacatttagtgtcgtcaacctttttacattttagccattatagtatgtgtttgatggtatgtcttgttgatttacaattatatttgtctgttggctaaggacattaaatatcttttcatgtgtttattagcaagttgtctatcttttctgcttgtgcgtatgaagtatctattcagatcttttgtccacttttaaaaactgggctatttttcttctttctgttaaattttaagaagtcttataatatttcacatagaagatctccctcagatatatggattgcgaatatttccctcagcctatgacttcacttttcattttattaagagtatcttcttataaaacgaagatgttttaaagtagataaattatatgtttttttctttgatattttatactttttgtatcacgtacgtgaaatctttacctaccccaaggatgcaaatattttttctctgtttttttcttccagaaattgtatagtgttaactcttacatggaaatttgtgattaattctgagtaaaatttgtgtgtaatgtgaagttgtgatactggttccttttttctcttccagatgtccagttgttctagcaccatttgttgaaatggcaattcttttctcattgaattactttagtacatttgttgaaaactaaattgatggaatatgtgtaggattgtttctgtcttctctattctggtccattgatcactctctttggcctaatgtcattaccaaactttcttaattgctatggttttaaagcacatcttgaaattatgtcttttaagtcttctgtcttcgtcttttttaaatgctttttttttcttcatgttttaagatgtatataagttttagaagtagcttgcaagtctctacaaaaatagccggctggaattgtattgaaattttataaaatttgttgtataaattttgggagaaatgatactttaccaatacgtaattttctaattcatgtgcatggcatatctatttatttagatatttaaaaatcctttcagtagatatggttgtcggtgtatagagcttgctcatattttgttaaatttgtctctaaatatttcacaacctgttgctaataaatgatattaatgtttgcggcagcgctcctttcacgggggcaccagctgcggggggtctgtcccttgcagatccttgacctggcgacggatgaataatgtatacttgacccacagatattctgctttgccaatccagttgagggtgttcaagctgcttacagactccccactgagtgctgtaaacagttgtgactgccttgatcagctagtgagactcgcatttattcagtaagactgattaacaaaggcttgagtcaacaccagtagaaggtaactgacattgtggacttctcctccagtaaaaagcacttaagcacccaaggtacatcaaaggttagtcttttttttttatttttattttattattattatactttaagttttaggatacatgtgcacaatgtgcaggttagttacatatgtatacatgtgccatgctggtgtgctgtacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgctataaatcatgctgctataaagacacatgcacacgtatgtttattgcggcactattcacaatagcaaagacttggaaccaacccaaatgtccaacaatgatagactggattaagaaaatgtggcacatatacaccatggaatactatgaagccataaaaaatgatgtcctttgtagggacatcatgtcctttgtagggacatggatgaaattggaaatcatcattctcagtaaactatcgcaaggacaaaaggttagtcttaagatcagatgagtaaacaagctagctaggtaaactactatgccgtcctttgttgctgctttaatttgtttaaaggtaaagggaccaggctgcctttagccagttctattaccgaagctatgcaaacttctcggcctttcaagatttgtgtgtctctataactatctctgatatttttcctaccagcctgattgaacccctacaaatgttaatttcaatttctagttgcatgttattactctattaatataattgttttctattgaggtacaattcaggtaacacaaaattattatgaaatccacaatccagtggcatttaggacattcacagtgttgtgcagccaacacctgtatcaatttccagccatttccatcactgcaaaagaaaacccataaccattaaacaacccagccctgggcagctacaaatctgctttcagactttatggatttacctgttataaatagctcctataaattgaatcatgtaatatgtaatcttttgtgtttggctttttttcactgcatatttttttaagattcatctatgtagcatgtattagtactttatttcttttcattgctgaattatattccattgtatggatattttatcatttataagttgatgggcctttgggttgtttccacttatggctattgtgaatctgatcactcgtatcactactgtaaatctactacttatgttatgatatatagtatcgtcatcatcacttttgaaggaaatttgtgtttattataaatttttagttttattgtgtgattaagtgttgttaccactttgtgtaaggtactgatgttttcctgtgacataatgcatgattatgttttgtgaatgttttatgtgtagtgggaagaaggcgtattctttagtatcaaggcataagcctggaatctattcagctatcttgttataatatctaacttagtgattattttctttaggccttttacagtttttcatattttatatctactgttttgtactaagagtggtgtgctggtttctactaggtgtggtgtgctaaagtctttctatttgtctccttactccttatgtcttctgtgattttgctttgtaaacatagttgctttgttatttgtcactgaaatattcataactgttatatattcatgatgacttttagctttggtactaaaaaggtctttgtcatatttaatgcttttttggtttaagttttattttaatttaattgataccaggtttgtaatctctgcattcttattgtttccatttgcctggtaaaccttctctatctcttatttttagtttttctgagtcacttggttctaaatgtggctctactttagcgcatgtagttggttgtgctttatgagacaaaatagataagttaagcctattcatcttcattgttattattgataggttattttttctcatttatgttatatatacacattatttataatgtgtatcatattatatttgttgtgcttatttctctgtgatgtgtttctctgctctttaattaaaaaataatatttacattcatggagatttgtaattttgttccattactcacctttgtttttatttatgttttgaattttatttttaattttaattgacaaataataattatatgtattatatgtttgtggggtaaaatgtggcatttacattttgatatatgttttcattttggaaggatgaaactaagctaattatttttgtgttaataacatttaaaatctactcttagtaattttgaaatatatattctgtccagtagattactaaagcttattcctcctaaccgaaattttgtactctttgatcaacctttcttctttccccttccatcgctcctaaccctggcttgtggtaatcatcattctactttcttcttctatgaatttgatattttttagatcccacatataattgagatcatgtagtagttgtctttttgtgcctggtttatttcatttagcattaattcatcttgtctttttaaaagctgaggccgggtgcggtggctcacacctataataccagcactttgggaggccgcggatggcggatcatgaggtcagaagttcgagaccagcctgcccaacatagtgaaaccccatctctactaaatatacaaaaattagccaggcgggcattagtggtggtgggtgcttgtaatcccagctactcgggaggctgaggcaggagaattgcttggacctgggaggtggaggttgcagtgagccaagattgcgccattgcacttcagcccgagactccgtctcaaaaaaaaaaaaagctgaatagtattcaaatgtgtatgtgtatatatatatatatatatatatatatatatatatatatatatatatatatttcatccaatgatggacacctaggttgcatctatattgtagctattgtgaataatgctgcagtgaacacaggagtacgactatctctttggcatacttatttcatttcctttggctatatacccagaacaggagttactggacgatatggtaattgtaattttacttttcagatgacactccaaactcttttcataatgactattattttaaattttcaccaacagtacacatggttcctttttctgctcatccctgccagcatttgttaaatttcatcattttgataatagccacttaaacacgtgtgaggtgataactcattgtcattttaatttacattttcctaatgattagtgatagtgaacagtttttcatatacctattggccatttgtatgtctgcttttaaaaaaaatttatttaggtcctttgtccattttaaaattgtgttctttcttttcttgctattgagttgcttgaatttcttatgtattttgaatattagcctcttaccagatgtatgggttgtgaatattttctcccggtatgtggattgtctctttactctattgattatttcctttattgtgcttaagatttttagtttgatgcagtctcatttgtttatttttgcttttgttttgcatgtgcttttgggaaaaccaagaaatttttgcccagatcaatgtcatgtagcatttcccttgttttcttctacagttttgggacttacctttaagtctttagtgcattttgagttgagttttgtgtattgaataaggttctaatctcattattttgcatgtgaatatctagttttccctgcataatttattcaagagactatcttttctccattgtgtgttcttgacacttttgtcaaaaatcagtagattgtcagtgcttgagtttattgctgggctctatattctgttcctttggttgatgtttctttttctttatgttggcactatgctgttttgtttaatataggtttgtagtatattttgagatcaaatagtttgatgccttcagttttattcttgctcattaatttccatatgaattttaaaattgctttttctctttcagtgaaaaatgccattggcattttgtcagaaattgcattgacttagtatattacttttggtagcatgggcattttaacaatactaattatcccaatccatgaacatgggctacctttccatttatataagtcactcgctatttctttccttaatgttttgtggttttcagtatttagagcttttaagtccttggttaaatttacttccaagtattttttatgctatcatgaatgggattgatgtcttaatttctttttcagttagttcattgttagtgtgaagggatgttattgatttttgtatgttgattttgtattcttcaactttactgaacttctgtatcagttctaacatatttttgggggaatctttagggttttctgtagacaagatcatgtcatcagcaaacagaaacaatttaactttttaattaactttttaatttcctatttggatgccctttatttcttcttcctttctgtctgtttgctgtggctagaacttttagtactacattgaacagaagtggtaaaggtggacatccttgtcttctttttgattatagaaaaaagctaaactttttacctttcagtatgatgttagctgtgggtatatcataggttgatgcagaagtaattgtggaatatatgacctttattgtgttgaggcctggagcctgacaatgcagggactagtctggtagtgggatgggtctggattctgatactgcagtggccagcatggagcttgggactgtggggtcatgcttgaccttgggttcagtgaggcagatctggtgttgcagtccaatgaaaagttgagtgcttatttcattcttccttgacttaggggtatcttgctcagtgttgtgctgcttgggcttgtgggaggggtaatatggataatattaaactggcttttctacactattcaatgcatttttttttttctttcggactgcagtaaggtggtataatctcttgtctggattccttagctgttgggaaggtattatgatgcatggatagtttttcaaatgaatgtttctatgagagatgaacactagaaagtcttattccactatcttcctaacatcactcctctagagttttttttttaatccagatatatgggggttttagtagagttttatttgtttattattcatttttgacttaattgtattgtcatcaggactcattgtatgatactatttttaggaatttgttgcagttatcttcatttgctaatggcaagttaaatattataaatgatttatatatgctggtttttaaaaacaggaattgataaacataaaatttagggtagtggttacttctggtgggaagaggcagtaagaaaggttaagggagcaacacacagatcgatacaagtagtagcattagaaatctagtccttaaattagatagtttaattatcccattatataaattactaacagttttacaagcagaaaatgtacatgctatttaaaatcaccaccataatcttttgtcttcacaaaataataagcagtactttttttcagattttttcttatatagatgtaatttatatcattcccaagcaagacatagagtataatcaaaatacagtagttttctctgtcactgaccctttaaaatatattcagtgcaatacatttttcccttgatcttgtatgaaatctcagactcactcttagttaatataaggaactcctgagaatttaatttgcaaacacgtgtgtaagtaaataattaaacttgtctagatcagataaaagtaagaactctgaacatattttgaagccaaattttctcttctcctctattccatatgttctttcattcttagcctagtattttcctcctttcctggctcaataatttttttgatctttctaggggagaggagaaaattatagtcttatgtgtgaagaatagttgtcatatttagttaaggtcctctgtgtgagagatgcacaatggctgatccattctcacataaatgtctttgggggctcttctgagtcttgacctttctagatgcaattctcgtgatctgtgggagacacatactttcttcctgttctggcaacttttacttcagttttcagttgaagtcctccagcacttccaggcaatcctgttggtcagaatattaagtagatgctggctagctggaagaaacatactttctttttcttgacttcagtgttagtacaaatatttcctaaaagtaactgtttctatttgtccttccacctcagttaaatagccatagctggtcacacctaattcagaatttcctctaatatgccacctagattttaaggggacccacagcagactcttcaaaaacttctgtgaagtcccactcattaggcttgtgtaagaggacagacaaccactcccttggcaggcagaagactggattactaacactgaaatgggcttttctgataatccccatccaatctttccccctttcactctttttgccccttttattgactctatctggttcaaagattactggttttgaacttttgttttagtctcttcttttgaaaatgttcatattggtcttatatttcacttaggtatacagtatctattttctttcagagactcaattgaactagcaatatgattatctggttacatttgtttgcatttattaattcattaacatatatgttagagttactattgatactggaagaaaaataatgaaaaagttgaacattgggaaattttgactcattcacttaattttatatggctctacaattcaggaaaagaccatatcatttcatttttgtcaatagaatggtttagctaactggtagtgtacaagaacagcagtagttctcattaggtgtttttgaaagagttagtgacaccatcagccttgtctgtttagaatgtgttattggattggagaattaattgtaacctggaaatactgaaggcaaagatatctgctatgtgattatattgttgtcagtaagagaaagtggatgacaatactttgtggtggctgttagaatgaaaaggaggggtcagatacaagaaagattatacatgtagaaattaaaatctaccaattgactggatgttggacataattaagtgtgaggtttatgtcctaaataattgaacagtgctctttaagaaaggattgcaaagtaagaaaaggagacaagtttatatgaaccaaattaatcatgcaacttttacaaaatggaaagtttcgtctagtactctaaaaggatgatctaaaaagatctaaaaggatactctaaaaggatgaggatgatctcagaaacttaaaagggtgaatttagaggaaataaatagatgttcttttttaaaacacaatctgcagctatgtttttattattcttaccagtagtaataacagtggaagtaatatctgccaattattaagtgctcaatatgtgttatgtgtcttaaattacattacctcatttaattttcacatcaatcctggaagctaagtgctgttattcttcttttgcaaatgaagaaattaagcataaacaggttaagtaaattgtccaaggtcatatagtgattttagatgtaaattttgaacccaagctgtttgagtacaaagctctggcactaacgctttgaaactcactttattaaagaaatataccaaagtgaaaatggagagaagcccaaagaagaattagataacagttatatccacagtagacttcaggatatcccccaaagactttaaggaatttcacaaaattttcagaaaagtgaatttacttccctttaattaaaaataatttatactatctggtaaccttagtttttggatggcaagaggaagttacaggacataaaaataaggtaataataatacttgaaatgtgaaatgtgcatgtttgtgatgtagaatattcaatatcattttggttttgacttacagcttgtacatgcagtggccatgcaaatatctgtcatctgcacacaggaaaatgtttctgcacaactaaaggaataaaaggtgaccaatgccaattgtaagtaagaatgactttttagaactttcgtggattgaatttgtgttgttgaagtaatttttatgttttactttttaatttagtgttgtgctagttaggcatacctttattacaatttttaacttttattttagatttgagggtacatgtgcaggtttttaacatgggtgtattgcatgatgctgaggtttgggatatgattgatcccattatccagatactgtgcatagtacccaatagataattttaaagtactttttccccttcctgcctctctctctctagcagttcccagtgtctgttgttcccatctttgtgtccctgtgtaccaatatttagctcccatttataagcaaaaacatgtggcatttggatttctgttcctatgttaatttgcttaggataatgtatccatgtggcagaggatatgatttcattttttatggctgtgtagtattccatggtgtatgtggaccacattttctttatccagtccagtgttgatgggcatttaggttgattccatgtccttgctattctgaatactgctgcagtgaacatataggtgcatgtgtctttttggtagaatgatttatttttctttgagaatttacttgcacctaatgaattctctttaaaaattaaaccttttaaagaacaattttgtagaggctttaaaacaaccccatagaacatgttatcttttgcatttctagaaaaagatgcattcttaatcttatgtatcaaatctacattatctttacacttttctttcatattatacctaatataatgtctctatgccgttcttttttcagtcatttattattaattctgataattaattccaattcttgtcctttaaccctttcagctggttccttatattcatcttcttctcttttctctgttctttcagtatgcaggaaccctctactgctactctcctctctgtactttcatgaatgatttttgtcttagcatttagtttttattctaaaattttattttccttcaaaaattaactttaaaaggcagcattttaggctatttaaattgttttttattctttttcttgtttatctatattattaaaatcaaatttttatggttttgaattatatatgtacaaatacatgtttatattaggtatatatgtactgtatttgacacaaataataaattccaaccataataattacagaaacatagggaaagtttaataaagaattcttcaaaactataaatatataaaaatttatacctaaagtctattaagcatggaaaatgatccttttatttttatttaaaataaatatattacttgttgcagagttatcctaaatgtttcaagttaggtgattatgtctttgcttagccacctaagtattacagattttcaaattcagacaaggtaagcacaatcagtttttattccttctctatagtctgaagttaaatacaagttcacagcaaaagatcttgggggaattcctattaaggaaggccattttggtcttaaaaccaacggaattaaatcattgtcttctgttctaagatcaaggatgcctctaatactttgcaacactaaagcttgattataagtaaggccaacttcatgggcacgtggcctgtgaatttatacaggttcccacacttacaagggcagcacacttggtttagtgctctgctatcatcatcttgaaattcttaataacttttaaataagaactctacattcttcttttgcacaatgttctcctattccctgcaattatgtataatagcatgttctggttataagtaatgtttctcttgattaacttctattaaatatgttggttggatagcagtgtgcagcaatgaaaatattttctgtagaccatagtggcagtattacagataaaaataatatatgagattctaccatgatagtaaacactgtcaatcttcttagtatagttttacttaaatagtatagccatataactatccataataaatagttctttgatacagtattgcagtaacatatttttgtttacagacaaaagaaagcagaattttaattcattgaaatagtgagcttgtaagcttagctaaaatagagttataagatttggcatatgtgcaaaatattagaaaatcaatcatatagttcttaatgataaaagtacattttccccgttctcatttatggctttttatgaagaggataataatggaatactaatttgtaaagagtattttgtaggtggtatttgtacacagaattccattcatttacttttttgtttatttagcttttgagtatggagcaataaagaataggctcattatttttagagcaattaattgctataatctgcttatacctgaaaaaaatggtttgttaggaaggagagctactccttcaaatcagtaaacaattattaagtgagtacttgatactactaatgaagatgaataacatatggtttttgttgaaagtatctcagactagcagtgaagacactgaccaaaatacagtataccaatttcttacattagtgatttaatatgcttatgaaccccttccacttcttaggataatttctgtttggttttaagtatttagtcagatatcatatcttatatattcttaataaccatcctaaactgaaatcggttctcttcatatctgttaatttcttttcttgcattatttgtgtacttgtctgtgtcctttactagagtgaacttttggggggaccattgcaacaataccacaatgtaagtgttcaataaatttgtttaatagaatggaatgaagaaagtattgatggagcactgaaaagggaagtattaatttattttggttggataagaaaaatttaagtagaggatgtttgaactagaacctgaaggagtaataaaatcaactttctgggaaaagaaaataggaaacaaggggaaatgcatcaataaaagcaaagaagtagaaatgaacatgatcatagcatttccggtctttgctcaagaatgttgagagctggaaaaatattgcttctacccttacaatgaaaggggaaaaagctggataaactgtaaattcatgagttttcttgaaaccattggagaactgagaaaacagggtaatcaaatgaccacaaatctaaagagagacaagagactgcagagagatgagacatgaacattggcttacctggagcaaaatcatctggaaactgataagaagagatcagctagggtagttgatatttggcggggattaggtatacactgtcaatagtgtgaagctcctgggagccacagaaattggtagagtatggagagcatactctttgtagagttttcaagccacctactgtggctgccattcccttccaccagttgctcaggtaaaaaaaatgaacattttaagagagcattccttgtattgtaccttgtggaagggattggcagccgcagtgggcagggcatcagtagtacagtcaaaatattcatttagatgagcaccaaatgattcattttgctgtagtaatgacagttttcagtctttttttggcccaaaacacagctgatcgtcaaaaattgtaacttaaaaatgaatttccatttgtgtcatctctgatttttttgtgcagtggtttttagttttccttgtagagatctttctcttgcctgggtgttttcctaggcacacataattgtgtggcagttatgaatggaagttctttcctgatttggctctcagcttgactgttattagtgtataggaatgctattgatttttgcacattgtatcctgatactttgctgaagttgtttatcagctgaagaagcttttgggccgagactatggggttttctagatgtaggatcatgttgtctgcaagcagggatagtttgacttcccttctttttatttagatgcctttgtttatttcttttgcctgactgccctggtgagaacttcagatactatgttgaatggaagtggtgagagagggcgtccttgtcttgtgctggttttcaaggggaatgcttccagcttttgtgcattcagtatgatgttggctgtgggtttgttatagatggctcttaatattttgaagtatgttccttcagtacctaatttgctgagagtttttaacatgagtggatgttgaattttatagaaacccctttctgcatctattgagataatcatgtgctttttgtgtttagttctgtttatattatgaatcacatttgctgatttgcttatgttgaaccaaccttgcatcccagggataaagcctacttgatcatggtggataagctttttgatatgctgctgaattgtttgccagtgttttgttgaggatttttgcatcaatgttcatccaggatatccacctgtaattttctttttttgttgtgtctctgccaggttttagtatcaagatgaggctggcctcatagattgagttagggaggagtcccttttcctcaattttttattgaggagagtatatctggtagaattcatctgtgaactcatcatgtcctgggtttctttggttggtaggctattactgcctcaatttcagagctgattattggtctgttcaggaattctgtttcatcctggttcagtcttgggagggtttatgcgtccagaaatttatcctttttttattttctagtttatgtgcatggaggttttcataatgttctctcatggttgttcatatttctgtggggtcagtggtaatacccttcttgttgtttctgattgcgtttatttgaatcttctctttttcctttgttagtctagctagtggtctagcaattttattattttcttcaaaaaccagctcctggatgcattgatctttttatcttttgtgtgtgtgtgtgtctttatctccttcatttcatctatgattttgtttatttcttgtcttctgctagctctgggatttgtttgctcttggttctgtagttcttttagttatggtgttaggttgttaacttgagagctttctaactttttgatgtggacatttagtgctataaatttctctcttaagacttcctggaagacaacctaggcaatgccgtttaggacataggcatggacaaatatttcatgatgaaggcaccgaaagcaattgtaacaaaagcaaaaattggcaaatgggatctaattaaagagcttctgcacagcaaaataaagcattaacagagtaaacagcctacagaattggagaagatttttgcaaactatacatctgacaaaagtctaatttctatcatctataaggaatttaaacaaatttacaagaaaaaaccaaccccataaaaagtgggcaaaggacacgaacagacacttttcaaaagaagacatatatgtggccaaaactcatatgaaaaaagttctacatcactgatcattagagagaattaaaactggacctcttccttacactgttaatgcaaaaattaactcaagttggattaaagacttaaatgtaaaactatataatttgattgtgctgtggtccaagagactgtaatgatttcagttcttttgcatttcttgaaaagtgttttaattctaattatgtgattgattttagagtatatgccatgcagtgatgagatgaatgtatattgtgttctttttgagtggagagttctgcctgtatctatgagatccatttgatccagtgctgaattcaggtcctgaatatctttgttaattttctgtctcagtgatctgtctaatattgtcagtggtgtgttaatgtctcccactatgattgtataggagcttaagtctctttgaagatctctgagaacttgctttatgaatctggattctcctgtataggtgcatatatatttaagatagttagattttcttactgaattgaaccctttaccattatgtaatgctgttctttgcctttttgatttttgtgaatttaaagtctgttttgtcagaaactaggattacaactcctgcttttttctctttttcatttggtaggtagatttttctccattccttagttttgaggctatgtgtgtcattgcatgtgaaatgggtttcttgaagacagcataccaacgggtcttggatctttattcggtttgcctttctatgtcttttaattgggggcatttaacccatttacatttaaggttaccataaaatatttaatttccaacagaatttaacaaagacattgttatgtcttatatgcagtaagtgtactaactaaatgtattttggttggaaaaagataaacattgatttattaggttaatggttcttggtggagatggaatagcaccccctagaacttcataggttttcataattaattattctaataattggggagtgctactggcataagaggatgaatagtcacagcctcttattagaatgggcacttacagagaccaggaaataaataaaatctaagtccaaatatgtttcattgagtacagtagatctacaaactcactctgtagtcattttccctgttccttagttcataattaaaatggatgtatgtagcagccagcagatgtctcatattggcttcctgacctgtggagaaagagccagtaaggtagagaagggccaagagaaagaaacccttgaaactaattccattcattctggacccagtcaagatggcaaatcagagatctcatgtcaagacaaatagcaggctgctgaaatggagaaaatgagggattatgatattctcaaatatgagctggatcctatttataagtgtagtgccaaaataattccctagcttaaaatgtggacagaattgtgataaaatctaacagaaaatatattttctttcttgaaatcctaccacatgtcaatgtatacattctgtttctggtatgtaaaaagactgtagagactatatcatgtcttaggaaacgggacatatttgaaaaggaaatagtaatataagagccagtcaagtcatgttgtagacctctggaacattatcagagtcccctgtttaaaaacaattgcaatctcccccacagtaattttaccatgtagtttctaccgcatacattttatattatagcactatgaaattttaacaaatgcataggacaggaataatatgataattttagttcctatattatgaaattcagtagtactcataatttggcaccaatttaatatgtttttgtttttatctcttaagaggtatctcaaatattctccagacacattgtatactcacagatgtgtgtgagcaggatagctattggtgatgagattttcttaaatgaatatctcttggtcaaattctgaataatattataaaaggtatattttcaatttacatgatagttgcagttgtagaaaattcaatatgtgttataaatatgcaaaactactttgtgtttatatgtaaaatggagttagattccaggctgaaatatttatgagcacatttttcacctacttaaacatctgccatgttattctaaaattatatgagattttgatcccttttttattttgtggaattactttgtatttttgtaggatgtctgcacccctggtttctctttcattccattcagtaaattccagtggaactccataattatggaaataatgaattgttactcacaaatttatccccactcacaaccatgtgccttaaaaattagtgttttcccttatctagccaaaaaaagtttattgtttcactgtttaatataagagctcagatcattttattgatttctggtgaaaagtacatataaatggcactcttagatattttgttggtagattagtcaaaattgatgagttgattcaaaattgttttactctctgttcacagtaaattgaagataaacttctcaaaggcatttggaattaaaaataccatttcctaagatatatggcaatattactaatcaggatcttaattgtgctaattaacttataactggctccccttttctgttccttatacctttcccatttactgatcttacaacttcttcatagctacttacttcaggcttaagaccctggttctcagaattagggcacagaagaatctcctgggatatggtgactaaactcctgggatgggagccaaaattctactttactaatagtaaattgtgaaataaaaattcttgatacattttgagaaatgttgccgtaggaggatcttcctgaacattttttttcctccttggcttacctttaggccagtaatatctaagattattacccatttttctctatcttgttttatcaagtctcttttgtttgtttgttttgtgaaattgccttaatgatgatgccaatgaattcctttccgttttaggaagatcaaagttgtgccttcttttctagaacagattctggcacatactagggactttagatttttaaaaataatgtatcttggatctttatttttcctaattactctcatctttttttttttttttttttagtctgctatatggggaaaagtacatcttttctctatgtgacttaatctacattgttataatagagactacagaggaagaataattttctgtacagcctgcctgcacataggttatcacctttataaacacaattggataagtaactagtgactatggtcttcaaatactgacactaactttttttttgtttgttttgagacaaagtctagctctgtcccccagactggagtgcaatggcacaatcttggctcactgcaacctccactctctgggttcaagcgattctcatgcctcagcctcctgagtagctggactacaggcactcgccaccgcacccggctaatttttgtatttttatgagagatggggtttcatgttggccaagctggtctcaaactcctgacctcaagtgatccgtccaccttggcctaccaaagtcctgggattacaggcatgagccagtgcacccagcctccaacactaaatattgttaagatttttctaggttgttttgttgctgtatttgcaactgcagataagactaatggtttctttgtgataatgagttaagcagccttgatgtctaatatataagatacttgaggaactcttatgcttgctttattctgtaaacatttattcactgagaggctatgagacagtaccaaaagcatacatctgaaaatatcagttcagaacgcatgttactcatgttaaggttggccagtatgaaaccatatatggttttgtccgatttctacccttgaggaatatgttttggtaacaagtctaacttgagcatataacttcctatgtcaggtaaatgtttgagttcttttggagtatgacttaatgaatttaaagctcttggattttaggaatgtactttcaaagttaaatgttagttctcccatcagtctttctataccaacaccttgtccctcaaaactatactagattgaatgtcatttaatcgccaattttgaaaacattctgaacacaactcagctgtatttcgcagcctccattgcagttaggttggaagtcatgttattgggctctgtccggtagacagaagtaacacccaccacttctaggcctggctcttaaaaacctcatgtgccatacaccctctgtttcctcattcagcagttcaatggagaggaagatgaggatctgaaagattgcagaggctaggaatagcccagatcctggaagactgcatggaccaagaccttttctccaaatccattccacactggacagtgtcttcaagctggaatcaaacttattgtatagaactgctgagattttaaggttgcttgctagagttagcatattcttccatgagtaattagtattcccttagcatctagcttgacatccttaattactgtactttcatttaaataaccttaagggtcctgttcattaagtgtgactgctggagtaggttagtgaacagtgtggtggtatttaggtttaatttgttctttaatccccattcatctcttaaaacttgcaaaaacctcccagctttttttttttttttttaaatcaaagctgttctcatttaaagctattgtttgggagactagtatagtccatgatttccaacttgattattacattcacataaggcataaaagttaaatggctttatttaactctagatggtcagaatggttcccaatacatgatagaattgttggaattgctaataaaaaagaaaagtgcacagtaaagaacagagtatcaagttaagatttaggatatactacctacaagttggaagaaattagaaaaagaaacaaatgtgtatgtcaaagaaagagacagcactttaagcatttattttactttgatcagtcttctatatatttattattaagttatcttgaaatatcaggggatgaaataaatagcctagtatgtcccaacttaacattgtatgaagaaataaagttttaacatttaaatgtagaaaatatatctggtatatgtgtaggtgttttatcaaaatatggactctcatgtcaaatgcatgtgtgttataggatgaactactgctatacactagtatgtccttttgatttatttctggagctccagtgtagtggctatgttgtatagtttagcacttctggttttatggaaaaatggtaagtgactgaacatatttcagtgtaatctctttttataacaattttcttttttgtcttgttttggcaatttgccggtgcaaatatgatatcctttctttattgttaataatgtttgtcctctcacctcaacataatgttttgagatttatccaagttgctgcattcagatagctgtaatgtgatcctattcaatgttgtagagtatttcattatataattataacacacttcattcatttgcctgttttctttttttttttaattatactttaagttttagggtatacgtgcacaacgtgcaggttagttacatatgtatacatgtgccatattggtgtgctgcacccagtaactcgtcatttaacattaggtatatctccaaatgctatccctcccccctccccccaccccacaacaggccccagtttgtgatgtcccccttcctgtgtccatgtattctcattgttcagttcccacctatgagtgagaacatgcggtgtttgtttttttgtccttgcaatagtttgctgagaatgatggtttctagcttcatccatgtccctacaaaggacataaactcatcattttttacggctgcatagtattccatggtgtatatgtgccacattttcttaatccagtctatcattgttggacatttgggttagttccaagtctttgctattgtgagtagtgccgcaataaacatacatgtgcatgtgtctttatagcagcatgatttataatcctttgggtatatacccagtaatgggatggctgggtcaaatggtatttctagttctagatccctgaggaatcgccacactgacttccacaatggttgttttctttttttgataattccagttttgtttttcctttttcaccattactgttaatgttttatcagtattcttatatgtttcctggcttacaaatgcatacattttgttgagtgtgtattcattattcatattttcaactttggaaaattaactgttttgtaaagtgattatattaaattatacccattccaagtctttatgaattttattaatgctccacatctttgctgatagttggtattccaaggcattttaattttgacacttctgatagatgtgtaattgctatgttcttaagcttaaaaaattccttagttcttaaaagtttattatgtttaatctttaaaagtttcatctctttaatcaccggtggaattttctctttttatgatgtagtattatctcaagtttcttgtgatttttctgctggattctccttaatcatttttagtaatattttatacatgctatgtacacgtcttttgttggtgatatgtttagtaaatgtcactctgtggttggactttcatgccaatttgtatgtctataatgagacattcttaattttaatataatccagtatatccatcttttccctatggttagtgcttttttgggttctgtttaaaaattctttctgttctccattatcaagtagtattcagatagccagttggtcatggaatttatttttggcctgaaggttttaactttcatccaatttctttaaaagagataaactattcagatttttgtttcttctagtgtctgttttgttcttttcctttaaaatattttcatttatttatttaaattggattttatttttaaattgacacgataatggtacatatttatggtgttcataatgatgtttcagtacatgcagtgcataatgatcagatagggcaatcagcatttataatctgtttgtgttaggaacattaacacaaattatctttccagcgatttgagctatataatgtattattgttaactatagtcctcttaaagtagtatagaacattagaacttattcctcctatctagttgtaatgtaatatgctttaacaaatctctccttatttctctttccctacacccttcccagccactagtaccttctgttctactttttacttctatgagatcaactttttttttttagcttccacatgtctaaagacatgcagtgtttaactttctattcctggcttatttcacttcatgtaatgtcttccagttccatccatgttgccacgaacgacaggatttccttctttttaatggctgaataatattccattgtgtatatatcctacatttcctttattcatctattgatgtacacttaggttgattacatatctttgctattgcaaatagcattgcaataaatatgacgatgcaagtatgcctttgacatactaatttattttcctttgtataaatacccagtagtgggaagtctgcatcatatgtatggtagttctatttttagtattttgagaaatttccatactgttttccatactggctgtactagtttacattcttatcaacaatgtataagagttcctttttaccacatccccaccggcatcttatatttttgtcttaaaaagacacagccattttaacacagccattttaactggggtcagatgatatctctttgtggttttgatttgcatttctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagccgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgatttgcatttcttgatgattagtgatgttggccattttttcataggtttgctggtgattttgtatgtcttgttttgagaaatgtctgttcagattatttgcccattttacaattagatcgtttgttttcttgctgttgcaatgtttgagttccttatgtattctggctcttaatatcctgtcagatgaatagtttgcaacccattctgtggattgtctttttactctgttgattgtttcctttgctgtgcagaagttttttatcttgatatagttatatttgttaatttttgcctttgttgcctgtgcttttgaagtcttattcataaaatcttttcccagatccatgtcctgaagcattcccctggcgtttttttctagtagttttattgtttctggccttacatttaggtatttgatccatttttccgttgttttttgtatagggcaagaggtgaggggtctagtttaattctaatgcatatggatatccagttttcccagaaccgtttattgaagaggttattttttctccaagtcatctttgttcttggcatctttgtcaaaaatcagttggctgtagatatgtaatttctgtgttctccattatgtttcattgatctatgtgtctgtttttatgccagtacctgtcattttggttagtactactttgtggtatattttgaagtctggtagtgtgatacctccagctttgttcttttttgctcaggattgctctgactactaaaggtcttctgaggttctatacaaattttattttattacttttttctatttctgtgaacaatgtcattggtagtttgaaaggaattgcattcaatctgtatagctttgtgtaatatggccattttaacaatattaattgtgattcgtgggcatgagatgtctttttatttgtttgcattctcctcaattttatcagtttattttgtagttttccttgtagagttctttcacctccttggttatatttatttctaggtacttttttgttagttattctagatgagatttgcctcttgatttctttttcagctactttgttgtttgtatattgaaatgctactgattttttaatgttgattttgtaacctacaagtttagtgaattcattcagcagttctattaaataatagtgttttgggagattctttaggattttctgtacacaagatcatgtgatctgcaaacaggacaatttcacttcctcttttccaatttggatgccttttatgtctttttcttgcccaattgctctggctgggactttcaacactatgttggataagcatggtgagagtggtaatttttgtcttgttttagttcttactgaaaaacaaacaaacaaaaaaacaaaaaccaagagcatgatagtaaaacaggagtagattaaccctgataccaaaaccagacaaggatacaacaacaaaaagaaaactataggctaatatccctgatgaacatgtatgcaaaaatcctgaacaaaacaaaagtgttcagcttttccctattcaaattagtgtttggtgtggtttgtcatgtatggcctgtattgtgttgaggtactttccttctatacctaatttatggggagttttttttatcatggagagatgttgaattttgtcaaatgctctttctgcatcttttgagattatcatatggcttttttccttcattttgttgatgtgatgtgtcacatttattgatttgcattgtgttgaaccatccttacattccagggataaaccccacttgatcttagtgtattatctttttatatattgttggatttgatttgcagtattctgttcaggagttttgaaaatgtccatcagtgatattagcctatagttttctttttgttgttgtgtccttatctggttttggtatcagggttaacctagtcctgttttactatgatgctcttgtttactgctattttttcatttatcagtttggagatttcagaaagtttagccatttctctttaaaaattgctacttttttttttttttaacagagtcttgctctgtcactagactggagtgcagtggcacaatcttggctcactggaaactctgcctctcgggttcaagtgattctcctgcctcagcctcccgagtagctgggactacaggtgtgcaccacacacccagctaatttttgtatttttagtagagatgcagtttcaccatgttggccaggatggtctcgatctcttgacctcatgatctgcccgccttggccttccaaagtgctgggattacaggcatgagccaccgcacctggcctctctctctctgttttaaaaatattatatgatagcattttggtgggtttctttagggaaaaaaagagaaaaataagtgtgttttaccttttatatctttatatcttcatttaaaaagaaatattttattttcagagacagagtctcactcaacttgtcatccaggctggggttcagtgatgcgatcttggctcactgcaacctctgcctcgtgggttcaagtgattcttctgtctcagcctcctgagtagctgggattacaggtgtgcgccaccatgccctgctaatttttgtatgtttagtagagacagggttttaccatgttggccaggctggtctcaaactcctgacctcgtgatccacccacctcggcatcccaaagtactgggactacaggcatgagtcatcatgcttggcctaccccttcatatttaatcataaaaatgcaaaattatttagcagattttcagctgttttaaataatctgtaatattttaaaattatggctgttacatgccccttattttagtctctgagtaaaaaaattatgtatcttgacaaggtatatgtatatatttaaacatttgaatatatatttaatatatttaatatctaagtgttcgtattataaattcaaatatttaaataaattaaatatttaaatttaaaattttaatttaaacatttaaattaaaaatactttaaaacttataaatgtagaattattttatattttgttttatacaaaatgtgtataacaatgttagcgtttacataaatgataatcattatttaggtgacatttaatgagattatttacttcttcaaagtctgtaatacatagttcagcctaaatctgttttccatgaaagtccagctgcttgattagtttgcttagtggaaaaggagtatgattatctctttgcttagacacagaaaccctttgaaattacatttttaattaagccattacagaagacttctaaaggcttttaatgtttttatcagtcttgaagggttctgagtttttaaaatattatttagctcaaatatcagaaatattaacatgatttatgttgtaaagtatcaatttgtttaaggaattattatttatatttaaatgttttacattttatttacctgttgtaatctgaagttgaacttgctaaaataatttatgtctcaatttgcttttttattatgtgaattagattagtggttcatgttcatacctcaagtaaatatattgaaatattttatattataaaattctatctataacaaaaattttatgttgggcagctcctatattgaccattaattatctatgacttctggtattcataccattgtgtagttccatttccttccttgagtgtgggcaggacctgtgcttgcttctaaaccagaaaataatgcaaagttaatgggatattactcctattattttgttacattacatggtaaaagtgatggttttcacttctgtgaatatgctgtgaagtctatgcttcctagaaaacttgctctagtgattttttcttttgctggctctgagaaaaatgtagctgagagtatcctctagcagctgaggatagccaccagccaatagcaagtgaaaaaccaaggccctcggtcctatagtggtaaggaaataaattttgccaaaaacctgagggaaaatagaagcaggcatatgcctagttagtcctctgattaaaaccagtcccagctgacacctgattgcaggattacagtggaccctaggtgcagccaacgtcttgattgcagtctgctgtgactctgaatcagagaacctggttatgccatgctcagactcctgatccacggaaacagtgatataataaatgtgtgttgattatagttaccaaatttatgtatttttattgagcaatagataactagtacaaatattatatccaagtactctgatattttatttactgaattatacaactctacattagatatttttgtaatatattccttaagtgttttcagactaggaaggagatttctagtctttggtagatattttcttgaatggggaaaataatttcaacaatgcagattaagacttttcctagaacagagcatttctgaagaaattttacctttgtgtaaataaacacagtagactgttacagaataaatgagttaaactattttaattgatctgagtaatttacattttatatctgcaaaattgccttaataaggtatttgtaattttgttatattgttttcttcttatgttgaaaatagttagatcctccattctgatttcttaatttgcatttctttgggggatctacaatgaaattgatggattatgataatcttgattccagatcatattattattaggttacatcataatccataacggatatgccaaacattttaatatcacctatttataacaggttagcacagttttatcaatttatttttggcatgtgaggaatgaggtggggagtcattggtttgcatagcattgcattgtgtataagtaatattttatacatttgtttgggatttcatctgttttatcctttgtaatgagatattttcccatgagtggtgactctgctattagaatcaatttgctagcctgtgaggatcttggattttgagtggaagtataacaagtaagcctgcattcttttttctcttttgtcttttttaagtgaattaaacgtggaacaaatttatctgataggacgtgacattaatgaaaataaaaatttgtttattcttgcctaatcttaatttttatgatgatgtttaccaactcctatggtagactccttcacatttaccagacagacctcaacatttttctataaacaagacccttcctttcttgtcccatttatttatctatttattattggaatggactcatgaattcctgtttttttcccaatgatttataattcactaatgtttttaaccactttggtgctcacattgtccaagatttggccagtaggagaggcttcaagctagctcttttgtttatgtgacacacctatcattttgtgaatacttccttactttctggtataagaagatatttcaggctcatcttattcctcttctgcctcagttgtggaatcagctgtatatccttttggagctctagttccttgtaatggaatatcatattagagaccaagatcttggtgctaggtatgctttttgctctttgaggtatctttacttagtgggttgtttggtgaacaaagttaggaaataataatttatttatgtgcacatataaatatacatatgtgcacatacatgcatacatatgcatgtatatacacacatataaatattttagaaagcatttcttcataccaaaacttccaattcggatctatttctgcaaggcttttgtaccttctccggctcagtatttgttccttcttctacagtaaatgaacactgacttccaatgacatcaacatatttacttgtttgctcaattctatattgtaatctaaaatagtttcagatttactttgcttatatcacttcagtaagaaaacctacataaaagattctggaatctgatttcaagcttccctcctccaccttgccctgcaccaattcggagtatgtagtcaaattttgggttcctaagttactttgaaccttccttccctccctcttctcttactccctcccttcctttcttctttcattccttttttccctcttctcttcttccccttacctctcctcctatttccctccttttttactttctttttccatcaatatagagataggattcacttgaagtttattaggctcttatttctacttacttctaattttatgaattttttcctttcccattcttattgtattaaaataattaattaaatatgttgaacattaataacctgaaactacttccagtatactcagagagattattgttcatttctttctccctcttccagtaggtaaccaattttattgttttctggtttatccttcccatctttcctttcataaaagtaaagctgtatgagctgtgtgtgtttctgtctatgtgcgtatcttatatttatatatatagttattatttcaccttcttacacaaaagctgacatattattagatgtattttagatactcttttgagttttacattttttttcttctttataatacttcctggagctcagttaatatcagctcataaaaatgttcatttttttgttctgttttgtttagagatgtatagtattccattatgcatatgtaccataggttaacaaatctattcggggacatttagacatttttctggtattttgcaattaaaattacgctacactgaataaactcgtatgtatgtagttttataatattggaggtttttcttaagagcaaattcctttcaatgggattgttgggtcgaagaatacatgcatatgtagttttttagatattgtcaagttgtcctccatatgaattttctcattttctattcctactagcccacatgggatggcctattcatctacagactcataagcaggatatattgctatgcatctgaaattttgccagtcttgtggagaataatttgtgtagttttaatttatatttccattattataagtgaagttgaatatttttcatgtggttaagagccatttttatatcacttttgtgaattgtctcttcatgtattttgccagtttttctataaaattattagtttcccccttatttttaaagagttctttatgaattagggattatagctctttttcagtgagacataagttgcacatatttcctcccagtttgtcatatgtttcttgacagtactaattgcactttttttttttgctatgcagctttcttaaggtagtcatatttcttagtcttttaaaaattacatttggaattttattcatggttaggaagccttttattttgtaattaattatgtaattaacttgtcctttattatgtaaaggttttattatgtaattaacatcctttttttactatatcgaaaattttattttttacgtttagatttatgcttcatttagagttttattttgtttatggtatgaggattggatctgatttgatagttttacaatagctatcaagttgtcttaatttattatgaggactgtcttactccagtcatttaagacaacttttatcatttactagatttttagcatgtgatagttgagcctgtttctggaatttctattgtacacatttggtctatttatgtgctagtaccatactatttaattatagagactttgagtatattttatatcttttaggtctacctctcttcaaagctcatctttttcagtgtttttctaattattcttgtatgtttacttttgtccctaagcattgagatcaacttttctagctcctataaaatctcattggagttttcattgaatcacattaaagttaaagattatctttgaaattaattgctattctgatgatgttgaggtgtcctacaaaagaataaataatgtctttccacttatttacatctacttttgtctttttcaagctgagtttcatacccaaaatcatattgttatgtttttatagaaagtatttatttcattagctttttggaggtacctgtgtttccttaaatgacacatggaattaaactaccaaaaattggtgtttaaatttaactcataaaatttgaaaaccattttaatacattcaaaattatttcaaaaattattatttgttaatataaaccactttagataatatatgtttctaatttgcttttttgagctataaatatttaatagagaatgtagttcttgtattggacaccttccagaattctgcaaagtctttcagtttgattcttaacaaggtggtgttggtttgttttttctgttaattttctgtgcttgactattgaaaacttagaattgggatgccaaagttacttcctacacaagaacatatagtttcatccttccaagaaatttgtagtttagagaaaataaaatttcaaccattcctttgtaaaacttatactgtgttgaaggtaaatatattatagtaattttcagttcaatatatgattatgtaatttgaataaaccaaatattgttaacaaaaaagaaaatgttataactttcatattagagaaatgagtttgtatccttgagctttttaagtcaatatctcagtattatcactttgaaaacacttgagggagagtgataccagcaagatggcagaataggagataacctactaatatttcttcacaacaacaagaactctgcacttatctactgacaaaagtcactggcaggagcctcaggagtcaggtaggagggtgtgaaagcccactggagcccaaggcccaaagagggttgttttgagaatgcagactggcacccaggtaatagatgcattaattttgcttccaggttcaagcccagaaatggccctgatccccaagggatttgactacagccctgtttggccttgagcctgcaactaaaatcatcttctaaggggtctaggagcaatcatgtgtactagtgtaagagacttgtttgcccactgatatcagtctctgcagtgaacctagaagtagtcctgtggctcgactccagccctctacagttgagttcccagcacagaactgctcacacaaaaccccagagggagacttgcccatatcctgcagattgtgagtctgagcctccttgataggcttgccaaacttatctttcagtagtacccaggttgtcatctcacagcacatcctgagggatccagtctgacccccagctccccccactgtagtcaggtaactatcatatctgtgcagggacctgctaggagatgtgcaaccatctgaggaattgaggtgggctatccaacctttgtcccacagtagatcctgaggggacccagcctcagatttggcccctcctgctgcagttggtgacatatctctcacctgttcagagacctcctgggaggcatgattgtctggggcactgggatagtcttctgggctaggtttcctggccagctttcccacacagcccagttaccctccttggatcttccctaggtccatctgccctgcagagccctgccaaccttggagccctcctgagacttgtggcagatatgggcttagactgccctctagtgtttagggagttgcagtggtcatgggctcagagaacacaacagtcagtccccttagaaactctggaaggccctctgaagaaggatgagcaaaaacaaaactagactaggaagactggaataaacacctgatctctcagtgcacacacattgttgcatgtccataagcatcaagatcattcagggaaatctgatctcaccaaacagacaaaataaggtgccagagactggccctaaggtgatggagacatgtggtctttcagacaaagaattcaaaatagctgtttttagaaagttcaataaatttactgaagctcaaacttcagtaaaattcagagaagcaatcagaaatacatgaacaaaacttaagagattgaaatattaataataaaaacaaatggaaatcctggaggtgaatgaaatgaatgagtgaaatgaaatacaatgaatgaaataaaaatggaatagagagcatcatcagcacaatagatcaaacaaaagaaagaattagtgagttcaaaggtaggctatttgagaacatagtcagaggtgaaagaaccaaaagaatgaaaagggccaaagaaagcttaccagatctgtgggacaacatcaaaataacacatttgtgttattagaattcaagaaggagttgagagacaaaggggccaaaaacttattaaaaataataacagaaaacttttcaagcctggggaaagatgtgaatgcccaattatagcaaagtcaaaggtcaccagattcaatcccaataagaataccacaaggcatgtcacaattaaactcacaaagatcaatgactaagagagggtctagaaagaagtgagaaaaaagaagcaaataacatttaagagagatctaatataactggcagcatatttctcagcagaaacctttcagggcaggagggaatgtgacaatatattcagaatgtggaaggaaactacctgccaaccaagaatactataggcagaaaaggtgtattttaaaaatgaaggagagaaggacttctgcagacaaacaaaagctgagggaattaatggccaccagaccaattctgcaaaaaatgctgaagagagctcttcaaacttaaagaaaagaatacttacattgattgttaggctaatactgtaattttgttgtataaaccacatttatctttgtataaagaatgaacgacaaaactataaaaaactacaataatttgttaagagatagacaatatgaaaaatataagctgtgacatcaaaattcaaaatatggaaggataatgagttaaaatgtaccatttttgttgttttcttctttcctttgcgatcaaaattaagtttttattggtttaaaataacttattatgactataagatgtttttgtgagtctcatggtaatgaaaaagctaaaagctataatagataacactaaaaaagtaaggaataaaacacattactagagtgaatcacataaccacaaaggaagcctttaagagaggaaaaaaggaaaaaatatctagacaactaaaaaagaagttacacaatcgtgatagtcatcccttacctatcaataactaccttgaatgtaaatggttgaaattattcagttaaaagagaggctgaacggatagaaaaatatgaccaaactatgctgcctacaggagacttactttacgtataaaacaacatgcatagattgaaagtaaatggatgggaaaagctatttcatggaaatggaaccccaaaaagaacagaagtagctgtaattatatgaacaaaatagactttaagttaaaaactgtaaaaagagacaaggccattatataataatagcaggggtcaatgcagcaagcagatacaattataaacatatatgtgcccactagcagaggacctatgtatataaagcaaatattaatagatttaaagggagagatagactgtaacacaataatagtaggggacttcaacactccactttcagcaatgtgcagatcgtccagacagaaaatcaacaaagaaacttcagtgtcagacaacactcttgaccaaatggacctaacagacatttacagagcattcggtctaacagctgcagaaggcacagtcttctcaacagcacatgtaacattgtttaagatagattatatgtaagggcacaaaacatgtcttaacaatttttttttttttttttttttgagacagagtctcactgttgtcacccaggctggaatgcaatggtgctatctcggcttagtgcaacctccgcctcccaggttccagcaattctcctgccttggcttcctgagttgctgtgattacaggtgcctgccaccatgcctggctaatttttgtatttttagtagagacggggtttcaccatgttagccaggctggtctcgaactcctgaccttaggtgatccacctgcctcggcctcccaaagtgctgggattacaggcatgagccatggcggcctggcctcaaatttttaaaaatcaaagtcatatcaagtattttttttctgaccactgtggaataaaactaaaaccaataacaggaggaactttggaaactgtatacgtacatggaaattaaacaagtcaatgaagaaattaaaaaggaatttaaaacatttcttgagaaaaatcagaatggaaatacaacataccaaaacttatgggatatagcaaaaacagtttttagaggaaagtttatagcaataatcacctatttgaaaaagtagaaatatctcaaataaacagcctaatgttgtacctcaaagacctagaaaacaagaatgatctaagtccaaaattatgagaaggaaagaaataataaagaacagagaagaaataaaggaaatagagactaaaaatacaaagcatcaagaaaatgaagagttggtttttgaaataagaaacgaaattgacaaagctttagctagcctaagaaaaaaagaggaatgattcaaatgaataaaatcaaagatgaaaaaggagacatcgcaactgataccacagcaatacaaaggatcattagagactataatgagcaatgatagaccaataaatttgaaaactttgaagaaatgaataaatttcttatagcttatcttaccaagattggatcatgaagaaatagaaaacctgggcagaccaataatgagaaacaagattgaatcagtaaaacaaagactcctatcaaaaaaagttcaggacctgacagcttcattgctaaattctagcaaatatttaaaaatgaactcataccaattactatcaaactattccaaaaaattgaagtagagggcattcttccaaactcattctatgaggccagcattaccctgataacaaaaccagacaaagataaaagtataaaataaaactacaggccaatatccctgatggatatagatgcaaaaacccataatacagtactagcaaactgaatccaacaacatattataaggtcattgaccatgatttagtgaaattcatcccagtaatgcaagtacagttcaaaccacaaaaattaataaatgtgttacattgcattactaggatgaaggacaaaaaccataggatcatctcaatagatgctaaaaaaagaatttgataaaatttaacattcctccatgataaaaccgctgaaaaattaggtgtagagggaacacacctcaacatatgtgcacatatatgcatccacagctaacatcataccaaacagggaaaagttgaaagctttccctttgaatgctgaagcaaatgccatagtatgatggcattcctatcaaactatgacattctttacataattagaaaaaattattttaaaattcatatggaatcaaaaaagagctcgagtagccaaggtaatcataaacagaaagaataaagctggggataccatgttaattgacttcaaactatattacaaggctgtggtaaccaaaacaggatggtacttatacaaagacagacacatagaccaatggatcagaatagagagccaagaaataattctgcataggtacaactatctagtcttcaatgaagctgacaaaaacaagtagtgatgaaaggactccctattcaataaatggtgctgtaatacctggctagccatatgcagaagttgaaactggacccctttcttacaccatatacaaaagtcaactcaaaatggattaaagacttaaatgtacgacccaaaactataaaaaccctgaaggataacctagataccattctggatgtaggacctggcaaagatttcatgacgaatatgccaagagtaattgcaacaacaaagaaaattgacaaatggcgcctaattaaactgaagagcttctgcatggcaaacaaaactaccagcagagtaaacagacaccttacaaaataggagaaaatatttgcaaactatgcatcccacaaggatctaatatctagaatctatatggaacttaaatcaacaagcaaaaaacgaacaaccgcattaaaaagtgagcaaagtacatgaacacacacttttcagaagaagacatacatgtgtccaacaagtatgtgaaaaaatgctcaacatcactaaccattagagaaatgcaaatcagaaccacaatatgataccgtctcacaccagtcagaatgggaattatttaaaaaaataacagatgctggcaaggttgcagagaaaaggggaccttatacattgctggtgggattgtaaattagtttagccactgtggaaagcagtttagcaatttctaaaagaactcagagcagagttaccatttgacccagcaatggaacacttgcagctataaaaaaagaacaagatcatgtttttggcagcaacatggatggagctggaggccattatcttaagtgaactaacactgaaggagaaaaccaagtactacatgttctcactttttagttggagctaaacattttgtacatacgaacataaagaagggaacaacagacaccagaacctactggagaggtggaggaagggaggagggtaaagttagaaacaacacctatcaagtattatgcttattacctgggtggtgaaattatctgtaccccaaacctctgtgacacacaatttacctatgtaacaaacctgtgcatgtacctctagtataacctaaaataaaagttaagaaaaatgataggaaaacaataatttattgtacattttaaaataaaacagtgtaattggaaagtttgtgacacaaagaaatgataaatccgtgaggtgatggatgtccttcttaccctgatgtcattattatacaatgtatgcctgtatcaaaatatctatgtaccccataaataagcacacttactatgtacccataaacattaaaaggtaaaaattggccaggtgcggtggctcaaactgtaatcccagcactttgggaggctgaggtgagtgaattgcttgagtccaggagttggagaccagcctggccaacacggcaaaaccctgtcttaagaaaaatacaaaaagctagccaggtgtgatggtgtgtagacccagctactagggaggctgaggtgggagaatcacctgagcacaggagatgaaggctgcagtgagctgagattgcaccactgtattccagcctgggcaaccgagtgagactgtgtctcagaaacaaacaagcaaatgaacaaacaaacaaacaagttaaaaatttaaaaagacacacaaactaatgaaacagaataaagaacccagaaataaatacacgcatgtataccatctgatttttggcaaaaatgccaagaatacacgttagggagataatattttctttaataagtgatgctgggaaaaagtttcattaagaagaatgaaactagaccccatctgtcaccacttaaaaaaaaatcaaaatggattaaagatttaaatgtaagtcctcaaaatgtgagactactggaagagaacacggaggtaacactttattacatttctctggggaaggtttttgtttgtttgttttggaaaacacctcaaaagcacaggcaacaaaagcaaaaatagagaaatgggattacatcaaaacaaaagcttctgtgcagcaaaggaaataatcagcagagcaaagagacaacctatagaatgggagaaaatatttgcaaactatgcatctgataagggattaatatccagatatgttaggaacccaaagaactcaatagcaaaaaaccccacaagtagtaaagagtggacaaaagatctgaatagacatttctcaaaagaagacatacgaatggctcactgatataagaagaagaaactcaacgtcactcatcattaggaaaatgcaaatcaaaatcatgatgagataccacctcacactagttagaatggctgttatgaaaaagacaaaaaaataacaaatactggcgaggttgtggagaaagaggatcttctatccaccgttggtggaaatgcacattaatacagctgtttgtggacaacagtatggaagtttctccaaaaattaaaaacagaatgaaaatatgtttcagtaatctcactactggatatttatccgaaggaattgaaattcgtattttgaagatacatctgtactcttacttttattgcagcactatgtacagtagccaagatatggaatcaatctaagtctgtatcaagagatgaatggataaaaatatgtcatatatttttggaatgtattttatccataaaaataatgaaatcctgtcatttgggacacaacatggatgaacctagaggacattatattatgtgaaataagcacagaagaaaaatactgcatgatctcacttatatgtagactctaaaaagactgatctcatacaagttgagagtagaattgtggttatgagaattgtggttgtgagaagctgtggaggattttgaaaggcttgggagggtatgaggagggtggaatggggagagattggtcaatttatacaaagttacagttagataggaatcacactttgtggtgctctattgcatatttctaaaactagaaaactaccatcaatgacaaaatcttaaaagtggtgtttggaaatgtcacagaaaacctaacacccaaagttcctttgtttcacagagtccttttcttccaagttagtgttttaaaggattatcatattttgactttaattttataattaatatacagtaaaatttactcttcaactcatttttttccatgaatataaaaactagctagcacatggctgaaaaatgcattgggaatgtaatctgattatttagcctctaatttttcactatttgactcttcattatatatatgtattctactattcctctgttcttatgaatgcttctgaaaaactaaagacattttagactcttttacctctttaaacttttaactagagttgaaatatatgtaatatatttatataaaatatgtatgtaataattacttaaaccatatgcaaatataatttttagtatttaaatattaagtcactttattaagttaccctggtgcataaattttataataatttattttggaggacgttccaagaaatgttatgcaaaaccatgctatatctctattagacattgtcaattttatttggcaaacaaggttttgtgaacttgaaaaattttgaaaatacttatgattttctcccactgctgtagttaactatatttttatgtattaaatataagagtacatgagtatggatgcgcatatgttctttcactttttaaaaatctgtttatgtgaattcaaagtttgagctcctgaatttaatctatattagtcaattttgtttgggttagagaaacctttttttccaattatttaccggaggagatctgtttttaaaaatacagattaattggtgtagaaactggtgtagaaaatttttttaactggtgtagaaaatatgttaatttcaaacaataccacaagtgtgaaaataatgtggatttatgaattccctgaattttcttctacctaaaaatatctctgtatcttatttcagactttcacttcttctgtttattaaggcaggatacatatcccaaagctcataattatatttcatctgccttttaacattccttatatgcctatcatgtatgtttattttctttttcttcactatttcatctctcactttttctcatatataaagctttctacaattaattcaaatttcaaacacatctttcaaagatgtgtttttgaaatttcaaataatggtatagttttaaatatgttttgatgtagaatataaatacttttttgcttgaagaaaaacatgaggcttttgaattgcattgtttaatagtaaatgagtttttgtgtttctgcagatgtgactctgaaaatcgctatgttggtaatccacttagaggaacatgttattgtaagtatatgtgtattcttcattttaaataattggtgcatactattagtttcaaataataaaggtcatcttgaataactaaaattgtcatgaatatcttgcaatttctatttcttaaattttataatacaactttacgtatattgctaagaaatatattctcttaattatatttggtacattttttctactctgagcagtaaaatagcaatagattttgttgtgaacatagaacaaagtatagaacttgagtaaactcatgtgattttaatgtagtccttttcattatgatggatttttgaagaacttgaattttataatagatattttgcagaattttgggcattactaaaaggctgcactgattttgtaccaacagatgctttcattgggtactgattatatggtaggtatatatttaacttttgttttgttttctgagatggagtcttgctcttgtcgcccaggctggagtgcaacggcacaatctcagttcactgcaacccctgcctcccaggttcaagtgattctccagcctcagcctcccaagtagctgggattacatgtgcccaccaccacgcccagctaatttttgtattttttgtagagttggggttttgccacgttggtcaggctggtcttgaactcctgacctcatgatccgcccaccttggcctcccaaagtgctgtgattacaggcgtgagccactgcacctagcttatctttaacttttaaagaaacagccaaatgctgtttccccaaatggttgtaccattttacattcccaccagcagtgtatgagagtttcagttcttccacatttcagaaacttttttagagttagtccaagttttagccattctaataggtgtgtaatggtatctaactctcattttaatttgcactttcctaattactaatgatgttcagcatcttttcataggattgtttgccatctgtatattttattcgatgaagggtctgttgaaatcctttgcccactttttagattgtttttatattaacaaattttccacatacttcattctagatacaagtcctttatcagatatatgacttgcaaatattttttactagtggtaacttgtctttttatcttattaacactattttcttgaagaacagattttaatttagatgaagcttgacttatcagtttgttcttttgtgaaatcttagcctaacaggtcactgtgattttccccaggttttggtagaaatattatatttttaagttttctatttaagtatatggtccattttgaattaatatttgcatatatagtaggtgatggattgaagttctttttttctccatgtaaatatttaaatgttcaagcacactttatgtgaagactatactttaatcaatgaatttctgtgcacctttgctgaaaaacacttgtctgtaaatgtgtgggtctgtttctggactcttttctgtttctttaatctatttgcttatttttatgctaacgtagcacatttataattaatgtgattttataagtcctgaaatcggttagtatttattctccaactttgttcttccttttcaaacttgttttgactactctttttttttttgcatttgcaagtgaattttagaatctgcctttcaattttcaaaaaaattgctataatttgttttgtgattttgtttaacttatagatgaatttggggagaattggcatgttaactatagtgagtctttggaattattgtattttttattttttctcaattctttaatttttactattaatattttatagttataactgtacacatatttcacatttttgtcagatttatccctgtatattttaaatttgtgatgctattgataatgttagcttaaaatatttcattcctgatttcctgattgtttctggcatttataattgattttatattggttttacatcctgtagctttgcaaaagtcacattttacttctactaccattttttgttgactctcagaatttctacacatacaatgtttcctgcaaataatagcagttggatttcttttcctctcttgatggttttctttcttttttctgccttattgctatagctagcacctttaataatgtgttgaaaagatgtgaacatgaaagtattattgtcttgtttctgatctaagagggaaagcattcagtcttttatcattaaatatgatgtaggtttttgctaactgcctttatcagattaaggaaattgccttctattcctactttgctgtacattttttatcagaaatggttgtttatgtccaatgcatttcctgcattaatttatatgattatcagaaatttctattttactttgttaatatagtgattttagtatttttaatttaatgaacggtatacagtataagaatatactaccatttttgtccattcataagttcatggacattgggatttttttctaggttttgtcattaagaaaaatgctgcagtgaatgaacattcatatggtctttatgtgaacatatgtttttattttccttgggtagattcctagcaatgtatagtttggttgtatgataagcttttgcttaactactttagaaactgccaaatggttttccagaatgttggtaacattttttaatttattctagaaaattttgatactagaaatttcattccttgacatcctcatcaatacaacattgtctctttgatcatagacattctagagtgtgtatagtggcattttgtggttttgttttgtatttctttaatgactaatagtgttgaacttgattttatgtgttgatgccttgaaaatgatttgctgggtgtgtaaaatttatccttttttcagtttttgttgctgttttaaattgtatttttcaaaattttgttttctactcttgtttgatatataaaaataaaattcgttttagtatattgatcttatattcattaactttggtgaacgcttactaaattctgtttgtagatttgcttggatttttaaatgcagttaattatattacatgaaaataagcacaattttcttcctttttcaatattttttacccttattgggatgttgagacctctatttctgggctgaatcacagtgatgataatagatatccttatcaggtaggatgtttattataatttatggaatattccttgtatcacattaagcaaattcctatcttattttgtgacaaggttatatcatgaataactttcttttaccttattaaatactaagttaaattaatagattttctcacattaaacatcttttcattctgggctaaaccatacttagtcatggcatattagtatttggatactgctaaatattagttgtttatattttaatttagaatatttttagtatgaaagaagacgatctcttttttgaatgttattttttctgactaaatgacctatgactgcagtttttaaaaattattttctggccgggcgctgtggctcacacctgtaatcccagcactttgggaggccacaaagggcgaatcacgaggtcaggagatcgagaccatcctggctaacgcgttgaaaccccgtctctactaaaaatacaaaaacaaaattagccgggcgtggtggcgggcgcctgtagtcccagctactccggagactgagatgggagaatgtcatgaacccgggaggcggagcttgcagtgagccgagatcgcgccactgcactccagcctgggtggcagagtgagactctgtctcaaaaaacaacaacaaaaaagttttccattctatatatctgcaattgtggtaaaagcttttaaaaatgaatttggaacaattgctatcttcttttaaaacaggaatagttaaaactttaaataaaaattaggtatttcaacaaaaatttttgggtctagtgctttttaattggtagttattttatttttttattttttgctatttcatagcattagcttttggttttatttatcttttctgtggatcttgttttttagttcatcaatttcagattttgtctttaataatttccttctcatatactgtttgttgttgttttgcctatatttgctatagtattttaaaattatcatttttttacagaatttatgaattccttttttatctttaaaaacgtaattattttcttagttcctttcttaagtgattcttattttttaacttttattttaggctcagggctgcatgtgctgcctgttatataggtaaattgcatgttgtgggggtttggtatacagattatttcatctcccaggtaataagtgcagtacttgataggtagtttttagatcctcaccctcctccaatccacaaaacatttgttaactatttttaattttttaaaaatgttactgagaatgtggcatataaaatcccaaattttgttaaggtatttttgccctttatgacacatttgatagggtatggaggcaattttgtttgtcacaacaggggagtgggacgtgggtgccgtgggcatctcatgggtagaggctagggatgctggtaaacatcctgcaatgaaaaggtcaacctccccagaacaaaaaatcatgtggccaaaaatatcaatagtatttaggttgagaaatcctgatttagaggcttaatcaaatttatatctgattttggagaaaataataattgtagatggtttggttttctttgtctagaagagtcatatcatgtctgttagtgtctcttatgttcttggcacacactgacgctcaatgtttagattttaattgatcaagattgaaaagatataatattctgccaggcacagtggctcacgcctgtaatgccaacactttgggaggccgaggcgggcgaatcacctgaggtagggagttcgagaccagcctgaccaacatggagaaacccgtctctactaaaaatacaaaattagctgggcgtggtggtgtgcgcctgtaatcccagctatgtgggaggctgaggcaggagaatcgcttgaacctgggaggtggtggaggttgcggagaactgagattgtgccattgcactcgcacctgggcaacaagagtgaaactaaaaaaaaaaaaaaaaaagaaaagaaaagatataatattccaatttcttcttcatgttttggtttgaatacttcggtaaaaacaaattttcgctcatcagctgtttggttgcttattgctacagttcgcatagggaaggcatgataaatgttacagtttttccctgtattttttatttattccctttactacttttatgtatgtatttatttatttaaaattaaaagttagctcaatatctttcaaaaatgacagtttttgtcactaatgaacttatagatccatacatgttttaatccgtgtgcaattattattcctactgatgctcagactgtccaattactgtgtcatttaaattatctttattctctagcttttccacatcatttttgtttttcttatttcaaatatcctggatttattttatagggatttttttctttggttttttaaaattagaaattcctctttttttgagcctttagtttcttttatctgccaaaggagtaactagttaccattatgaacacattatgtaatctctgtttattacaaatatactaatgtttaacccttttataaaaactagcataatttttcttctatgtcaatgttgtccaatacaaatatgatgtgagcctcatatgtaatttaaaattttctagtagcttcctttaaaaagtaaaagaaaatgagtaaaattaatgttaataaaaccttttttagcttaacacatctaaaattttttcattttaatgtgtaatcagttttaaaagtcattaagtcattaatgagatatcttactttttttgtactagtgtttgaaacaaagtttacattccatacttacatcacattttaattcaaatcagttacttttcaactagtcaatagccacatatggctagtggtgaccttattggacaactcttctctagattacataggatccctgcgttcttttagaaatatcagaagcataatggtaaagcactaggtggcactcttggtattgctgtgagacgtttaaagcttaatatttgaaaagaagtgatgcttaaaaaagaaaaggacaataactcttgtaataatgttaatagaaactattctaattttcaagattagatcgaaatttaagatgcaagtccacactgtaacttaaagcaattgagtgcaatgtggtattaacttaattgaaagtgatatgtcagcagttgtaatctatttacttagtagtttttcaaagttcattttaaaaccaaaaaccaaatatattataaagcatgcctcacaaaggagggaaaacgttcaaacagtgttaactaattttattggcccttgtaaacattgaattactcaatatatttttagtaaatacaaaaagtagtagtcacaaagtatcacaaagtagtatagtttttttttcttaaatgctttcttttaattgtaataacaattttaacaaagaaaaccttaaaaatgaaagactaggctgtagaaatgctatatagatgatatatttcaaaaagtagaatgagagtacataaagtcactttctgcagtcatttactttatttcactattgtgctaattctttaaatacatgtaatttgcaatgctcacacccctaattattgtgttttaatatacttccaagtaattgaacacattttatttcatcttttactctttaaaaaattactgttttatgttgaatttcttttattagagtttcttttatttagagttcatggtggaattttgtagtaataataaactacctattttgagagtaggaaatttaagttgaaaaagatgacttaaaatagtatgtcagtttaattacttaaaatagtatgtcatagaaaacaatgaaaccaattaatacttgaattgacccttatatttaatggaattatcctggtttttgttctaaaactgaataaaataattttcctgttttaaactgaacattttgttagtgaatgttttatatgactttttaactattggctataaattgctatttaagtaggatctggctgtttcatttgcacatggggcagagtgatcttaataaacaccaataatctaaattcttatatttaccagattgcagacatgatggattgaacagtatctgacaagacataaatgagtcacatttttggcattttaaccttgttctttgattcctcagtatttttattaaattttctgaagtctgtatccctgtacttttagatttttatttcagaactatttactcctttagcatagtccaaaatgatggataataaacatgattataagaaaatttaaaatagctaaaaggaaaaaaattgctattaagttaatgtagaagaaggatgaaaatttatttgacttatatattttacaataaaagtgttacattattattttcatgtaaaatcatagactcactgtaaaaaataataaaaaagtttaaggaaggaaataaaaatgtccataaaccttccaccaggtcccccaagttgagttgtgtagtatgtatcctttgtaagggtactcagctgagtggaagattgagagctgatatgctgtacttacctttctcactaagccatgtaccctagtgtggggctgtgtctgccttgagccagaggtatatagttctttatttgtgtgtaaaatgttgaatggtctactgaagggactgcctgccttctaaataaatctctgcatcatgtcctgagaatgattttatgtcatagaggtcataacatgcataatattattgtgaatgtttttcttatagatatatagctcattattagcatttagtaaataaaacatagtttttcccaaactggaaaagaacaaccacctgactttaaaataatgatcatactagttaacatttattgagaacttactatactagactgttctcagctttttatatgtattagcttatgtaatactcaaatgggaagggtatgcttattattcccattttatagataagaaaacagagatagagaaagctgaactaatttgtataagatcacacaggaaatagtaaaggcaggtttcaaccctcttaaccattaaagaagtggaaatcagtggtatatgtaagcaaaaagtttttatatgagtgaaataaaaacattatgctgaaggaaataagaggatctaaataattaaaaaatcatatgccattttttcaaataagaaatattcatccaaagatatcataacttcccaaaattgatataaaaattttatgtaattccattatagaatttcattcaattttttctgaaaggcatgcattccaataaattaccttaaggttcaagttaaataatacacttttagaatatccagttagattacaaacaggaagaatagtaagaaattcctactttaatagatatccaaacaaactgtaactctaactgcatccactggctcccaaacttgtattagaatatgccactaaatcaatgaacaagttggagtataagattaagttcctgataatttgggaatttatatggtactatggtttgaatgtttgttgcctccaaaattcatgctgaagtttaattgacattttaacagtattaaaacctgggactttttttttttttttttttgtgacggagtcttgctctgtcgcccaggctggagtgtggtggcccaatctgcaagctccgcctcctgggttcatgccattctcctgcctcctgagtagttgggattacaggcacccaccaccatgcctggctaattttgtttttgtatttttagtagagacggggtttcaccgtgttagccaggatggtcttgatctcctgacctcatgatccgcccttctcggcctcccaaagtgctgggattgggacctttaagaggtgactaggccatgaaaactccaccctcataggtggaatttgtgctgttattgaaaggcaacttcagttccttcttgttctctcttgccctttggccttctgccatgggatgacacagcaagaaggccctcaccagatgccagctgtttggtcttctactttccagccttcagaactgtgagcccataaatttatatttattataaattacccagtatgtggtattttgtggtattctgttatagcagcacaaaacaggctaagacatatggcaagtcattttatttgtatgtctttaatgacttaatttgcttgttcttagatatctcaaactttacgaagattatggctttcgcatttactacttttctctctcaagtactctatccccagctaatattccaaacctaacaaaaatgactcttccagatatcacaaaccttttgtttccatcctaacacttacatagtataaaattatctcagttgatttctgtttttaacttgaatttaggtttttaagtaaaatgaaattttactagaatcaaattctgtgaacactgtaccttgttttattggatctccatacttagaaatctgtatgactcataacagaccttcagttatgtttaatggtagtagactcatataagttattaatacataagtgaatatacatttattttagctgtatgagcaagcatttttattgttggggtacttgagcaaaaatgtccagagatcatattgtagattatcaagtaaaagttgctttaagtttattacggacatagggtaatactattatatcactgaaaaactttaagtatcagtcttttatttaaagaaaaaatgaatttcaaggtttgttttcttcattgaacatttctttcaaatgaaactaaatagatgaccattcatcattgcaggataattgaaagtttagtgattttgagctattatgaagtaaaaaaaggtggcttctgaataggtcatggcatattattaaaaatcccataaattagaaaaattaatgtatggcattggtgataatcatccattcttatgtatttaaaaaatttatttgtaagactgaatgaatttaaatgtatatcttaggtcatacaattagtagttttcagagtttggattataactgtgttttttctatgatatgatatctagcaaatgctgaacctacaaaacttgtgcaacagattttacttttgaaattgttctaaatgttccagattcagtagaaattcttaataattttcagcatggatagtacagttgagcaaacaaggaaaaactagtatttattaaatatttatgtacaaaacaattttatattaataatttcagtattcccaagggtgacatattttttctcattaaattactttctggaggattcgactgttagagcttggagagactgtcatttacttgcgtttactgacttgtgtttattcattctacatttacttattgactagctactttgttagactccatggataacaaagtgaacaaaatgttttttcctctattgaagcttatacactactagagaaaatagatattaaaccagttatatgattttcataggtgtgattttcgtaagagctctgaatgagaattatagagttttgggaatgtatttccaaactttatagagctttgggaatacattacaagagggcctgacctaatttgtgggatagggagtaggtgaggtaagggaatgattgagctttgatttgaagaaatgacttgataagatgtgatagtgtgagggtagataggaagaagtggaaccaaaaaggacagcatgtacaaaggttcgtgactagaaagaacatgcaatgtttgagttactaaaagaaaaccaatactgaaacacatagaatatacagagcaaaaataggaagcttatgagatctgcaagatccaaacaatgctatgctttatagaacatgtaagatacggtctttatcataagaaagataggacgccattgaagggtatttagaggagagaaaaatgttacattttgcttttaaaataatcagtctgctttcagtatgtaaaacagcttagtggcggcaatagagcatgaaatagaccatttttggtttattttttgaggcatcttcctggagctatctgtaaaatatcattacagcacattgagactgttaaaatacttgtacttttattcacatgggtttttatcatttactaaacaattgtctaagtttgcaaatagttgtatttataatcgtaccattgtttaaatgtttttggactctcgatattgttgtcaaagtctgtatgtatcctttatagactcctcaggatggctgactataagatcataaacatatgtttattaacaaacatatgaatataaataaacatacatatgggaatctgacttttgaaatccttcagaattcattcagaaataactacagtgaataaggcagtgaaataactttatcgaatgcctttattttatcagacagtcttctctaaggcaaatacatactcacacaattacatttaattcacagagcagtcctatgacataggcggttttatccctgttgtaccattgggtctcattaagcttagttaacttgtataaaataacctagttgttatatgggagattacaaccaagatctccttaaatggtatagatgatgctaaattaaaactgaaacgcaatattaactgaatcattaactcagtggaaaagcaaattattaagctgcagtttgtttctcaaaaaattcacatataaaatttcagaaacaattcaaaatttatatctaagaattcttcttcccaaataagttgaaatttacatgagcagtgccattgatacagcatatgcaaatcaggcttatttttatttgtcatcctaacatgcctgccatcttgcatctcagatataaagatatttccagtatacaccttgatgattttttttatcactggttactatcttcttaaaaaatacattatttcctgcagattttgttgcaagagtaaagcaaatcttaaatattcactacttgctcttcatcatcccaagcatgtaatgtactcagaaactttcttcttagtttctctttcaaaatgtctttttatgcatatacattttagtcatcactttccacctaatcattagtttttaatatctgacttctttaaacatcttgtatacgttaaaagccttttctctttatatatttttgcttaaactcctttttcatgcaatgtgttttactcatcagcttcatttagtatataatttgttcttgtagtaaatagaaaacacttttttgcactacggctgctagaccagtattgactaaataaccttaaaaaaatcaacttctgcatgttgaaacttaatcctgggcatattccagtcatataagactaggatgagagactgattatcttgtatgtttttgttagcctatatctaagaagtttgtgtattaagaatgaaatatgccatttttggagagaaacataactacagttgacccttgaaccccctgaggtatagaggcaccaaccccgcatgtagtcgaaaatctgcgtatatctttttactctccctgaacttaactactaataggatactgttggccagaaaccttaccaataacataaacagttgattcacatatattttgtatgttatatacattatatattgtattcttgacagtaaagtaagctagagaaaagaaaatgtattaagaaaataataaggaagagaaaatatatttagtattcattaagtagaagtggaaatggatcgtcataaaggtcttcattctcaacgtcatcatgttgagtagactgaggatgaggaagaggaggggttggtcttcctgtctcagaggtggcacaggtagaaaaaaattcacatatgagtggacttgcatagctcaaacctgtgttgtatagggtcatctgtatatcaatctaattatttaatatgtaagtatacatcatgtgaaaaacatgttgaagatcaaggattaaaacaaagaaactctctgaacattggtttacattttttttggcccaatagtggaaatactgcatgttcattctagaaaagagataaataaaaataaaaataaaaattactaatttttctacctagagaaaattgttgctaaattgtactagttttccagtcatttatttatgtattgatactctgtgttagggtgagtaatgcaccccgaaagatgtctacatcctccccagaacctgtgatacatacttaccttaaatgataagaaggagttacatatgcttaaactaaggattttcagagagactattctggactatcctggtatactcagtgtaataacaagtattcttatgaaagggaagcggaggaaatttgactacagtagtaggagatgtgatgatggaagcaagtggagagatgtgaaggaagggaccatgagccaacaaatgaggacaggctttggaagctggaaaaggcaacttttaccatacattgattattcttatatgaaagaattattattaatgtgtttaccaaatgatgattttctatttcatcatttgttttacattattaactgtaagggagagctgttccttctccttcctcattaatttgtttaattatttatttatatcggtatgaactcatggatatctatttaattttatgatttataagaaattactgtcgttatttattttgtagctgaaattgttccagatctggtcattaagatccccctcaatttggcttctgtgttttttaacataactccatcatttgttgagtgcatccttattttctagcactacaagatatttcgggcttaccttgtactttccctcttccatccctgaaatcaactagttcccatttccccaagatgccatggtttcttatattggagaataatatttagaaaccaaaactggggattatatatgctcattggttctggggttttattctttctttcttttaaaaattttatgggtttcctgacccatgcactagggtataacaatggtattacccgataccttgtcattaataacatcacctatgaaataccaaattcaaatatcttacacctttagtccttcttgctcactaagtaccaatgccataattattcaaactcattgaaatttgtaattcattaaccctacttgttttctcattttcaccctttcctagtgccctgctgtcttcttttatacccttaaccatgtgaggttttatgccattatagttatcagtccttagctaaaactgcatattttcttcccactcctgtttcttctatctacttgtgtagcaaaatccaaactggttaatccaactcttcactactctgtgtctgaactttcttcaccctcacgttgctggggggaaaaaaaaatcatatagctgtgttgactgtttggtcttgagctttatcaaaggaaaatgcaaaactacctggtgtttttcctgcatttcctttataatactctccaaataagtgttttaaaacttcatctctattctcaaacctttatctgcaccagctaataattttacctcctacttcattgagaaaatataagcaaatagatgcgaatgttcccatttttttttaccaccacaatcaccaaacttttttgcacctatacttattttctctgcctttagtttattatcgaggaaagaataactctgttcctaacaaaagcctatttttcaatttgttttgctctaaattttatacctttaactctttaagggactttgctcttccatttctgctttatcaacagttgcttagactctactggaccaatttccttagcacacatatacatgttttaatatatcttatgttaaaaataaaatttttctactccccttatacttctccaactattgcaccatttctgtattttctttcagatcaacccttctcaaaatagttgcctaaacttgtcaccaaatccttaccacccatttcctcttcaatccccacaactccatagacattgcttttctaaggaaacataccacagagtcgaacagttgaaacagtctatttcttgactttcctatcatactttccaatttttcctactctgtcactgactgcacctttttagtcttttttacttttttttccacttgaccttatcagttcccatagttttaagaagcatctaaattttgatgttccaaaacttgtagttttgatcacttttctgagctgcaaactgatttctctgactttctgtttgatatcatcatttagatattttattagaaagtcatattcagtattttcaaaacagaactctaagtttttcctcattttataaaacttcattctttactcagacttcctcatttcagtaaatgtacataatgcctatatacttgcttttgtcaaatatctgaaagccttctttgattcctgattccaaagacttctttgagcccccctctctgatacctttcctttctcaacccttactttgtgagggtgtttagtacttcagttggatttccttatacaatatatcccaaagatatatatctttctctcttctacttctcccaccctgtccaaggcactgtcattttgactctggtcctttttagaagcttccttgtgtagttttcccattttcagttttaattttcttcagacattctccaatcggccaccagggtgacatttaaaaattaaaaatcagaccatctcactacccagcttgagatctttcatggttttccatgatgtggcccttacctgctttctgactttatctcttacaaccctccacaaatcattctaagcacagtggaattatttttttttcctcaaacagcgcagcttcattttcatttgtgtttgctctctctctctctctctctctctctctctctctgtgtgtatgtgtgtgtgtaaacaatcaggaactttttcactgtaaacaatcaggaactttttcactgattgtttacatgatttgcttctcatttttcatttatcatttcagatgttgtttccttttgtgtgccttttgtaaagcaatcttctctgaacctgtaatagggattggtaagcttttgctgtaaagggccaaataatagatattttaggcatgacaggccagatggtctctgttgttcctactaaactctgccactgtagtagacaagcaaccatagacaatatgtaaatgattggttgcggctgtgttatcataaactatctacagaaacaggctgtggaccagatttggtctgtgggcagtaatttgtaacacctattccaaaacattaccttgcgatcttcatagcatatatcactctcttaaaatgtcttgtttatttgtgtgattatttttggctttctcttctattaatagaatgcaaactccataggaacaaggcctttgattcctcacttctatctgtctataattctgattggaattttattaatttaaaagattaatctgaggagaacatatatatattttcttaagtattaaaatttagaatgctccttagcagtctatttatcatgtatagttacatcttcttttatgacctaaaatagattttgtagttttgtaaattaaattttttgtagttttgtaaattaatatttagtttatttctgggatttcatttggtttggagatttttattagtttgctattcagaatggaatttttaaaccattacattttctgttgaatgtaaaacctctattgatgtaaaagaaaagctattgatgattatatgtgtttaaatttttgcatttttttggtgatttgatatcatcaaattattctgttgatgatttatagtgatgccattaatgacaaatttttggtctcaaagtctataattgaaataaatgtaattacacctgtttcttttgattagcatttgcctgatgtgtctcccttcatcctttcagtctgtgggctctctttttataggcatatctcttaaaaatagaagactttgattttgctgttttctaatctgtacatttttgtgattaatgatgagttgaatccatttatttttggtgttattattcatatctgaatctatttataccattttaattttttattttgtatttttactttttatatatttgtttttaagccttttatagcttttttggaaggggaaacatactgatatccccctcctataagataaggattttagcattctgtaactttttttgaaattcttttataaaaccacagtgttttgatattctctagactttctattcttggttattatggatacgcatgtttctttggacatcgcaatttttacaaagataacaaattcaccaaggtattttatcagccccatctccgtatcccttgatatattttttgctacacattctgtatttatctcttctctttttaagtctttaatcaaaaattgttttaacggaagtctgcatgtcaaagcttctgaattctctatgcctcagagtatttattattccttcctatttgagtgtatgcaactaataaagtagacttaatatgtggagcaaaaattgattaaactacaataaaaaattaaacatacctctttagagtatttctagatcaagcagacaaaattcagaaagaatatcaaagatctgaagaacacagttaatagaaatatgaattatagccataaagatttaaaagaggatttaaatttgcatttattttacagatgatataattgtttccataagaaatcgaagtgtctacaggcaaattattagaaataacaggaatgtttgtcaggttgttggatacaaaattaatattaaattgccttcttagacatgttcctctaccagctgttagggctaactagatagttacagtaattaaggcagtgtagagttgtttttcttttgttttttggtgcagggataggcatagtcactgaagtaataagataatctccaaataaaaggtataggtatttatatattaatatttaagtcatatctggctacattactgaattgtttattatttaatagctttttagttgttttatattaatttcttggtaaactgattctaggcagaaaaagacaactttgttttctttttaaaaatattcatatttctgtataattatatttttgtaatttacctctgtcatctattcaccttttttctttgccatttttgtatttgtatttgtctcttagttgtaatgtgtgtgtgagttgattttttttttcaaaactgatatgtagattatgtccttttaggacacctgtttacctgaaattattttattttattttattttatttttgaggtggatagagcaagatatttatatcttgctctgtcacccaggaaggaatacagtggtgccatcttggctcattgcaacttccgcctctcgggttcatgcgattctcctgcctcagcctcctgagaagctgggattacaggtgtgcgccaccacgccagcctatttttgtatttttagtagagatggggtttcaccatgttggccaggctggtctcgaactcctgacctcaggtgatctgcccgccttggcctcccaaagtgctgggattacaggcttgagccactgcacccgaccctgaaattattattatattgttcttgaatggggacagcattgctgagtatatattttccataaatattacttcttttttttattttgacatttatttctgcttaagagcacttggctgctgggcaaaatggcttatgcctgtaatcctagcactttgggagactgagacgggtagatcacctgaggtcaggagtttgagaccagcctggccaacatggcaaaaccccatctctactaaaaatacaaaaacaattagcaggatgtgggggcacacgcctgtaatcccagttactcaggagctgaggcacaagaattgcttgaacctgggaggcagaggctgcagtgagccaagagtgtgccactgcactccagcctgggtgacagagtgagatttcgcctcaaaaaaaaaaaaaaaaaaaaaaaaaaaaagccttggcatgttgcctaatcctactctgtaaataactcatttgtccgtgtgtgtgtgtgtgtgtgtgtgtgtgtgtgtgtgtgtgtgtgtgtacacttacctacatggacatgcctggatgtctgtaattttttttaacaataacttcatagagatatattcacaaaccataaaagtcaccattttaaagtgtacaattcagtagcttttagtatattatacacagttgtgcaacgatctgcaccatctaattttggaacatttttatcgctccagaaagaaagctgtacatgtcagcagtcacttatcattcttttttcaccagctagtggctaccatttatcttctttttgtctgtatggatttgtctattttggacataacaaaataaatcagtcttttgtgactgatttctttcattagcacagtatttttgaagtttattcatgttatagcagaaatcattactttatttctttttatgacaaaataatattttattgtgtgaacatatcacattttgtttaccattcagttgaggtacatgggttgtttttacattttggctaatttgaataatattggtgtaatataatatgctttttatatttatacaagatacttcctttaaatatttaggttttcttcatcaacagatttttttctttatttaatatatgtgctacccttcaactcattatgatctctgctttaactacattagtcatgcatacactgaatttttctgtgtatcatttctcttgagtgattttcatctctatttctattttgggaggctttttcgtatttgacctacatagcactatttcagtcttatgttgtattaattattctgttttctgattctcgtattaactttttaaattttgccattacattattacttttttgttcttccttttgtaatttatttagctctctttttattgtaatctttggtgttattatctcatctttcatctttaattttgtggagtcagtgttttttagattttattttctcttgacatgttccccatgggtattttaaatagctaaaaaaactctgtatttatattaattgtatctacttcatctgttgttgtcaaattgagattttgctctttttctcttcttaccattgcaagtcaaaataatgtaagaaaagcaaaaatgtttactacttttcctatgtttttgtttttatgatttaaaaaacatatgcaattggaatttggagcctgaagtatgaatggttttgtattctcctgaagctctacgaagctcatacaaaaagtgagaagtgtaaataagagaggtctttctttatatctattttacctatttttataaactatttttatataaaattgggaaattaattgtggatctccgattttcttggatttatgagaggtggtttgcttggatttatgaaaggtggtttgctgattgttcgccaaaatatttaaaagcagatacatatatcatttaaagtggttctaacctctgggctcagtctttaaaatcaaaaggttgatttatagatacttacagctttgattcttcaagccttgaaatacagctatttagtatttttttctattaacaaagttttccaaaaggtgttcctagcatatttaaacataaagaatagtttatctttttttaagttatggaaatttaaaatgtgttaaaaagtatagtatatatacttctattcatgtagtatatatatttcatagtatatagaatatacttaaaaattgtgtacctgttaccaagctttaataaagcttaacgccttgctctatttgctttggattttttaaaaagaaagtaaacatcacagatagagttgattttttttgtgtctttttttagatagagccaccaaactgtattttgttttgtccttattatgctaatgttatttgtttgcaatatatataataatcaatatttattgagtactttatatatgtcaaacagttataagtacctttaatttgttagctcacttaatcatccataaaaattaatactataccacattatttaaaatatataaaaattacatactctgtgaatcctacaaattgcttttatgtgcaacatatttgagatttatcaatgctaatatatgcagccatagtgcatttattttagttatgtagaatatttctacaggtataacatttatttccccattctccttttgatgcacatctaagttgtacttaatttttcaaaataatatataattctggaattaaaatccttacacatttctacttgaactggaagttctttgagatatacaagtagaagtggaattgtagatttattagatttttccaaattacactgcaaatatttatattaatttatgctccatcatggtatacaataattttcttccacttcctcaccaacattttatgtttttagtctctttaatatttgccaatctgatggttttgaaatactatcttgtttttacttgcattttctttatgactaattgaaacaatatcattttacatatttattgtgtatttaagtttctcttctttgaattgttgctcttattctttgtctttttcttattttgtagtttgtctttttcatattgttggcattttcttattgatttatactagttttaatgtaataaattctggatattaattttttgttcattattgatacagcaaatatcttctcatagtctatgacttggctcttgatctttgttaaaaatgacatttatacattcttctctttgctacatggcacctaccctaaactcgaatatcaaccacataattggatataaaacaatcctcagcaaatgcaaaagaactgaaatcataacaaacacactcttggaccatgtgaaaatagcagtcaggacaaagaaaattgctcaagaaattaaataacgtgctctggaatgacttttggataaataatgaaattaagggagaaatcaagaagttctttgaaaataatgagaacaaagctaaaacataccagaatctctgggatatagctaaggcagtgttaagagggaaattcaaagggctaaatgcccacatcaaaaagttagaaagatctcaaattaacaacataacatcacaactgaaataattagagaagcaagaacaaatcaaccccaaagttagcagaagacaagaaataaccgaaattagagctgaactgaaggaaatcaagacgcacacaaaaaaaaaacatttaaaagataaacaaatctaggagttggttttttgaaaatattaataagatatgttgcaagctagacttatttttgcagttgaaagtaatggcaaaaactgcaattacttttgctccaatgtaatagcgtgccaaccaacaacaacaacaacaacaacaacaacaacaacaacaagcataggtcctgatgaattcacagatgaattcaaccaagtgtacaaagaagagctggtactattcctacggaaactattccaaaaagttgaggagaagggacccctccccatattattctatgatactcatatggacaggaggcagggaaacactgggtagaagagggcagtccctgggagggccccaccctcaagcctggaacagtagcccaaagggagaaatttctatcaccatatttctgctcgaatgttgccttttccaaaatcgccctggcccaccccactcccctgattctgtacccataaaaaccacaggctccactggcagaggtgctgcagaaaaggagagaagagaagaagcagccagacattggagagaagcagcttgacttcagagggatggcttgacggggaatatcagaggagagcttggctggggagagcaagactccggggaaagaccaccttctcacctcatattctttccacctccccttcccactgcaagccactttcattggcaataaaatcctccatattcaccaccctccaatttgttcatgcaacctgattcttcctggatgctgaacaagagctcaggagccatgggtatggacacttgagctatttaacacttaagccttccgtggatggcaaagctaagaagacactgtaacacatgccctctggggcttcaggggttgtgggtaccccccagacactgccatggggctgcacagagttttgcttctgccggcacccagaagcattcatcccagttgctgcacctgctcacttgcatgctcctcctcccacaaggggttatttaagagctgtgggctgagtaagtgaggcaccccttttgtgagacccatgaagggtcagggaaaatgttctgtttcaatgccagcatcatcctcataccaaaacctggcagagacacaacaaaaaaagaaaacttcaggccaatatcttggatgaacatagatgcaaaaatccccaacaaaatacttgcagaccaaatccagcagcacatcaaaaagctaatacaccacaatcaagtaagtaagtaggcttcatccccaggatgcaagattggtttgacacaagcaaatcaataaatgtgattcatcacaaaaacagaactaaagacagaaacaacatgattatctcaataggtgcagaaaaggctttctataattaaaaactataacttaggtattaaaggaacatacctcaaaataataagagccatatatgacaaacccacagccaataacatactgaacagacaatacctggaatcattccccttgaaaactggcacaagacaaggatgccctctctcaccagtcttattcaacatagtattagaagtcctagccagagcaatcaggcaagagaaagaaataaagagcatccaaataggaagagaggaagtcaaactatccctctttccagaagacatgatcctatatgtagaaaatcctatagtctgagtccaaaggctccttcaacttttaaacagcttcagcaaagttgtcagatacaaaatcactgtacaaaagttactagtgttcctatgcaccaacaatagccaagctgaaagccaaatcagaaaggcaatcccattcacaattgctacaaaaagaataaaataccttagaatacagctaaccagggaggtgaaagatctctataatgagaattacaaaccactgctcaaagagaagacacagacaaatggaaaaacatccagactcatggataggaactgtcagtatcattaaaattgctatactgcccaaagcaatttacagattcaatgctattcccataaaactaccagcagcattcttcacagaactagaacaaaactattttaaacttcatatggaacccaaatagagcctgaatagccaaggcaatttgaagcaaaaagaataaagctggaggcttcacgttacccagcttcaaactatattacagggctacagtaaccaaaacagcatgatactggtacaaaaacaggcacatagaccaatggaacaaagtggagagccaggaattaggctacacacctataaccatctgatcttcaataaagctcacaaaaacaagcaatgaagactcccttttcaatcagtggtgctgggataactggctatccatatgcagaagattgaagctggaccccttccttacaccatatacaaaagttaactcaagatggattaaaaacttaaatgtaaaacacaaaactataaaaatcctggaagacaaactaggcaatgccatcctggacaaaggaactggcaaagatttcatgacaaagacaccaaaagcaattgcaacaaaagcaaaaattgacaagttggatctaattaaagagcttctgcacaacaaagaaactatcaacagaaactatcaactatcctgtagaatgggagaaaatatttgcaaactatgcgtctatcaaagatctaatatccagcatatatatggaacttaaattttcaagaaagaaacaagcaacctcattaaaaagtgggcaaaggacatgaacagaaactttcaaaaaaagacatacatgtggccaagaagcatatgaaacaaagctcagtatcgttgattgtagagaaatgcaaatcaaaaccacattgagataccatctcatgccagtcagaatggatattattaaaaagtaaaaaaataacagatgctggtgaggttgtggagaaaagggagcactcatacactgttggtgggagtgtaaattagttcacccattgtggaaagcagtatggcaattcctcaaagagccaaaagcagaactaccattcaacccagcattcccattacttggaatatacccagaggagtataaatcattctaccataaagacacgtgcacacaaatgtccactgcagcactgttcacaatagcaaaaacatggaatcaacccaaatgcccatcagtgacagatcagataaagaaaatgtggtatgcataaaccatggaatactatgtagccataaaaaatgagatcatatattttgtgggaatatggatagggctagagactattatccttagcaaaccaatgcaggtacagaaaaccaaatactgcatgttctcacttacaagtggtagctaaatgatgagaactaaagaacacaaagaaggatacaacagacacgggggtctacttgagtgtggagaatgggaagcgggagagacagctattggatactgggtttaatacctgggtgatgaaaaaatctgtatgacaaatccctgtgacctaagtttacctatgtaataaatcttcacatatacttctgaacctaaaattaaagttttttaaaatcaatatttattgtggaggggttttcaactttattaattttttcctttatgattgagatcttaatgacatgcttttttaaggtcataacagatgctctcttgtatttttgaaaagctataaagttttgcttttaatatttaggtctttaattagctgaaattgatttttatgtttgatataggatataaatccatactgtagtttttcttttttattgtttgttcctgtgccatttattgcagtctccctttcaccacagatttttctaaagtactttattgagatacaattggcatagaaaaactgtacacaataaatatccacaatttgataaattaggaaataattatacatctatgaaaccatcagcacaatcaagactataaatatatccatccaacaccttaagttatttaattaattttcttaaaacttaatataagacctaacttgttagcaaattttaaaaatatacaatacagtattgttaactataagtactatcctgtatagtagatcatcagagcttaatcattttgcataactgaagctttgtaccctttgagtaacccttccccttttctttctccctatcccagcacctggtaaccacctttctattctctgcatgtatgaatttgattattttagatttcttataaatgtgggataatacaatatttgttcttctggtcaggcttatttcacttagcatcatgttctccaggtctatctatgttgttgcaaatggcagaatttccatcctttttaatgctgaacaatatttaattgtatgtatatactacagtttctttatctgtcatctgtcaacaaacactaaggttgcttccatgtcttgtctattgagaataatgctataaggaacatagaagtctagatatcactttgagatcctgagtttagtttcttttgatctgtatatacctaaaagtgggattgctggaacagatggtagttctatttttaattttttgagaagacaccgtactgtttttcataatggcagcaccaatttgcattcccataaacagtatacaagagttttttagagaaatgtctattcagtctctttgcccagttttaattgggttgtttacctgatatatagttgtttgatttccttttatgttttggatatttaccccttgtccaatgtatgatttgcaaatattttctctcattttgtaccattttcttttgttgattgttgcctttgctgtttgatgtaatttcaactttttagtttgatgtaatttcagttgtcaatgtttgcttttgttgcctgtgcttttggtagtatgttcaagaaatcattgtgtactatgcagccataaaaaatgatgagttcatgtcctttgtagggacatggatgaaattggaaatcatcattctcagtaaactatcgcgaggacaaaaaaccaaacactgcatgttctcactcataggtgggaattgaacaatgagaacacatggacacaggaaggggaacatcacactctggggactgttgtggggttgggggaggggggagggatagcattaggagatatacctaatgctaaatgatgagttaatgggtgcagcacaccagcatggcacatgtatacatatgtaactaacctgcacattgtgcacatgtaccctaaaacttaaagtataataataataaaaaagaaaaaaaaagaaatccattgtgaagttctctgttgataagcatttcttctgtttccttataagagtttgatggtttcaggttttacatgtaagtctttaatccactttgaattgatttctgtgtatggtataagggtctaatttcattctttttcatgtgaatatgcagttttcccaacaccatttaatgaagagactatcccttccccattgtgttcttggcatccttgttgaagatcagttaactctacatgcatgggtttatttctgggttctttaccccgttacatttatctatatatcttttttcatgccagtaccaaactattttgattattatagccttgtaatatattttgaaatcaggggtatgatacctccagccttttttcttcttggtcagaatcgttttgactatttgggttatttggtggttccatatgaattttaggagttttttctttctatttatgtaaaaaaaggcactgagattttgacaggatttgcaatgaatctgtagatcacttttagtagcatggacattttaaccatattaatttttccaatccatgaatatgggatgtcatattatttatttgtgtttaatttcttttgtcaatgttttatagtttttaatgttcaagtctttattctctttggttaagtttatttataagtattttatttcttttgatgccattgtaagaatgttttctttaatttctttttcagatagttcattgctagtgtatagcaatgcaacagatttttgtatgttgattttgtatcctgcaacactgttgaatttatttgttctaacagatttttgtgtttgtgtgtgtgtatgtgtggagcctttagtattttatctacataatatatcatcagcaaacagagattactttttctttctgatttagataccttttctttttcttgcctaattgctctggaccttacttccaatactgtcttgaatagaaatggtgagagtggacatcccttccttgttctggaacatagaaggaatacttacagctttttatcattgcatatggtattagctgtgggctattcacatatgatctctgttgtgttaattttctcctatacctagttgttcagtattttttatcatgaaagggtgttgaactttgccagatgtttttctgcatctattgatgataacataatttttatccttcattctgttaatgtagtgtatcacatttattgatttgtatatgttgaaccatccttgtatctcagagataaagcctacttgatcatggggtgtggtccttttaatgtgttgttgaacttggcttggtagaccaatggaacagaacagaggcctcagaaataataccacacgtctacaaccatctgatctttgacaaacctgacagaaacaagcaatgaggaaaggattccctatgtaataaatggtgttggggaaactggctagccatatgcagaaaactgaaactggaccccttccttacaccttatgcaaaaattaactcaagaaggattaaatatttaaagtaagacctataaccataaaatccctagaagaaaacctaggcaataccattcaggacataggcatgggcaacgagttcatgactaaaacaccaaaagcaattgcaacaaaagccaaaattgactaatgggatctaattaaaccaaagagcttctgcacagcaaaagaaactatcaccagagtgaacaggcagcctacagaatgggagaaaatttttgcaatctatccatctgacaaagggctaatatccagaatctacaaggaatttaaacaaatttacaagaaaaaatcaaacaaccccatcaaaaagtgggcaaaggatatgaacagacacttctcacagaagatgtttctgtggccaacaaaaatatgaaaaaaagctcatcatcactggtgattagagaaatgcaaatcaaaaccacaatgagacaccatctcacaccagttagaatgatgatcattaaaaagtcaggaaacaacagatgctggagaggatgtggagaaataggaatgcttttgcattgttggtgggagtgtaaattagttcaaccattgtgaaagacagtgtggcaattcctcaaggatctaaatctagaaataccatttgacctagcaatcccattactgggtatataacctcaaaagtataaatcatactactataaagacacatgcacacatgtgtttattgcagcattattcacaatagcaaaggcttggaaccaacccaaattcccattatgttagactggacaaagaagatgtggcacatatacaccatggaatattatgcagccataataaagaatgagttcatgccctttgcaggtacatggatgaagctggaaaccatcattcttagcaaactaacacaagaacagaaaaccaaacaccgcatgttctcactcataagtgggagttgaacaatgagaacatatgggcacagggaggggaacatcacacaccagggcctgtcatggggtgacgggtaaggtgaagaatagcgttaggagaaatacctaatacagatgacaggttgatggatgcagcaaactaccatggcacatgtatacctatgttacaaacctgcacattctgtacatgtatcccagaacttaaagtataataataaaaaaataaatttttgaatagtaatatatgtaatactctctaatgaatatattctcaacttcgttgccctgtctttacttcatcctctatccacagacaaaactctaatacagtatcaactaatttctaagctttttttgaacactctgctgtagaaaaacatacgaatatactgatcagtctcacttcagatgcatgctcaccaatctcatactgtttcagcttcttcattcctgtagttcagcaagtgggagggagtggcatccagtggcttttttgctcccgttgttcggtgagcaggaaggaatggtgtgcaatgacttttttgctcccattgttcagcaagtggaatgaagtgttacagctcttttgttcctaccatctgcagcttggtgaatgggagggttacaggtcttttgtttccaccacccacagcttagtgagttctgagttcttttctcgtgaccatgaggaataaggtacgtggacaccggagagtgagtaaggcagaaaataattttgttgagcaacagaaggaaagctctcaagctctcagtggagagagggaccctgaaagtgggtagccctctgtgaggctgagtctggggtttttatgggcttaaaatgggggcaggctggtacttgctaattggtccataggtggtcttggaaaaagcagcattcaattagttaaaaggcatcatacaccaggaaccaatcgagagagtgggtgggttggcgatagaagttctcactctggttgtggactctatccagaactggcagttcaatttttcaggctttaggctgtctttggcttgaaggttggctttcaccggggacctgtccctgtccacctaggaatttgtctgtctcctgtcactacaaatactatatttcctcagtctatttactttccctctttttaatgactattttagatcttttctctgcccgcacatttcccaacccctcatcctccattctctttctcagctgatggcctttctgattttattgagaaaatggaagcaatataaagggagcttccaaatgatcccgccaccacatgtccctccctgctctctgttcagtatgatctcctccctgcatgttgtgtatattcagtctttatgtttttttcacaagatctcatcaccttttacctacctcagggaatagttccaaattcctcctccctctcctctctttgcaatttttccttttctaataatttttttccaattggcataaaatgtgttatttccccaatctaaaactgaagttttcttatgtgtcttgatcatacttattcttcatgctaatttttcatttctctgtatttatcaataaagcaataaattatttgaattgatttatagtcaatcatgttgtaatttctttataccataatagagtagttcattaatgcagcataaaaatttattttcaagttatgtacatttatggataaactagagacatgttttaaattttaaagttttatatcctgtaccctacttagctaagaagttcagagcatatttcagcattaagttacatgtttaagtgccaggtaaattttccattcataaccaaacacaccatcatgatttttgaaattctgaggagaaatatatctcctagttaagtggaaaattgtgcagttggtttctggagtactttcattctaagcagctttaaaaggaaacattttgtgtagaagtctaaattttctttctttatagtagtgcacattcattcattggtattcttattagacacttgaattgattaatactcctactaattttgttctagatctcagctttgtatttttagcctgattgacattaggattgatcattaccatacacaagatacttcatactgatctagtattttcaactctattaaatataagaagagagaaaatcatgcttgaatgcctggccaagaatgtggttgggcatatttgtggcagatgctggagtccatatagacagaaaaatgtctgtaggtctggggcattacagcctttactcaggactgtccagggtctgaagtctcccagttcctacctccaaaagggcatttatttcctggcttattaatgcttagttgcagtcttgaaaaaagaaagatgcttgagcagacaaatttgtggaaatagttttgaagtgcttgcttttccttcgtgatatttttttcttcattctaaatagatattctctttctcaagactgcagccctactttttgttgtgggaagtcagggaccccaaatggagggaccggctgaagccatggcagaagaatatggattgtgaagatttaatggacatttattagttccccaaattaatacttttgtaatttcttatgcctgtctttactgcaatctctaaacataaattgtaaagatttcatggacacttatcacttccccagtcaatacccttgtgatttcctatgcttgtctttgctttaatctcttaatcctgtcagctgagaaggatgtgtatcatctcaggaccctgtaataattgcgttaactacacaaattgtacagcatgtgtgtttgagcaatatgaaatgtgggcaccctgaaaaaagaacagaataacagcaattgttcagggaatacgagagataaccttaaactctgaccgctagttagccgggcagaacagagccatatttctcttctttcaaaagcaaatgggagaaatatcactgaattctttttctcagcatggaaagtccctgagaaagagaatgcgcacctaggggtaggtctctgaactggccctcctggggcgtacctgtctcttatggttgagattgcagaggtgaaataaactccagtctcccatagcgctcccaggcttattaggaagaggaaattcccacctaataaattttggtcagactggttgatctcaccctgtctcctgataagatgttatcaatgacagtggtgcccaaaacttcattagcaattttaatttcgccttggtcctgtggtcctgtgatctcgccctgcctccacttgccttgtgatattctattacgctgttaagtacttgatgtctgtcacccacacctattcgtatactccctccccttttgaaactccctaataaaaacttgctggtttttgtggctcatggggcatcacggatcctaccaacgtgtgatgtctcccccagacacccagctttaaaatttctctcttttgtactctgtccctttatttctcaagccagccgacgcttaggaaaatagaaaagaacctaagtgattatcggggcaggtcccctgataacttttgaatctcactcagctgcatttgtccaaggtgatcactactcagtcttttaaacattgtatttacttgatgtctatagcactaaattctgggtttctttttctctcctgagtagccatttctcagtctcctttgccagtttctcttcaggctctgattatttaacattggtctgcctcagggctaatctcttggacctcttgtctatctacgaagacaatttcctgccttcctggctttcaatcctatgtaatttctgataacttacaaattgttatctactacgcatgctcctgagcttgacttaacatctggctattcaataaatttctctaacttaatatctttaaaattaagctcctaattatttccccaagttccatcgcagtcaaacctattctccatttaagttaatggtgatttttgcttggtcttaggaaaaaattaaaaaaaaaaataaaactttgcctttctttcttaaaaaggctgcattcttttatagctaatcctgtttgctgtaccttcaaaatacattccctgtatttgaccacttcctgtggccttcactgctgttaccctggcctccattacctccttgcctgtattactggcacaggctttacgagaatcacagttaaggcttgcttttgctttgaggtttctgtacttgtcctctctgcctggaatatttttttctggtaaactccatggcttattctcttactagctcaattctctaaatgtttcttctgaaagctggaagcatactcctacctaacagtatctccctcctcttcactggtttattcttctccaaaagactgatgttcattcagtagagtattacttgcaagaggacagaaatttttatttttttattgtatctctagggcctagaacactggcacattgaattttcctctgcaattttttggcagtcagatgaaaattggaactatgacctactgcataattctcattatcagatataaggatacctataaattcttatacaaaatattgccttacactaaattatacaataaatatataggttgaatcttataaagtatacaagtaagcatacgaataatgccttaatagttttaaaaataaattcagttaatgtaatttaatctgtatgttctatattaataatttttaatggttaagggtataatatgaaaggtatgtatccaaaagacagaagtaatctatatttatttaaaataattggaaataatttttataaaagtagcagtttaatgttattagcaatacatcaccttcatgtaatatgcatagccactcatgacttatgacatttaaatgtttcaccttggttccagcattatgtatggacaaaattaaaaatatcttttcccagaattccttgtatcattgtgaataaaggtcatatctgtaaaatgatgtttatcatagaatcattttaaaattactaaaagtagaagtgaacacaatggaaaaacaaataaatacattatatgagaaatattatttagctatcaaacttcatgttttcaaagaattttgagtttgtgaaagttacaaagttttatgaaaatgtctatctttacagctacagaattctaactggaataaaatgcaccaaaatgttaactgtatttccttctagttataaaattatagataatttttattttattcacttacttttgtatagtttccagaatgtctataatgttttaactttgtaatagcatcagaaataataaataaaatttttaaggaattagtacttcttccataactatgttttgctttttgttgattgaggacaaagatttgtattttgttatacttaaatataccactagtatttaacaataatcatttttaatatcagtgtacaatatattgtaacctaaattttgctttttagacagtttttaaagtacatatcaggattgtactttttttcctccctacagacagccttttgattgattatcaatttaccttcagcttattacaggaagatgatcgccaccatactgccataaactttatagcaaacccagaacaggtgaggaaaaattgttatcttttaaagtataattattggacacaatttttttttcatatttcatttgattttacctcttctcagaattatcacattgtagggcctttgtagaaactactaatcctattaattttttctctcttcgtgattcaataatttgtgaatttgatatttcagattttgcaaatagccctatattttaaattaaatataatttgtcaccttatatatcttgtgacaaaatttatgcctataattatacaagcacggactgttcttatttaaaaataaaactcgttcgggcgcagtggctcatgcctgtaatcccagcactttgggaggccaaggcgggcagatcatgatgcccagagatcgagaccatcctggccaatgtggtgaatccccatctctactaaaaatacaaaaattagctaggcatgatggtgcgcgcctatagtcccagctactgaggaggctgaggcaggagatttgcttgaacccaggaggtggaggttgcagtgagccgagatcacgccactgcactccagcctggcgacagagtgagactccatctcaaaaaataaataaataaataaaactaatgaattcaaagcatactatattaaatgtattttactttcctttataccattccacagtaatatgatttgtcttttttctcagtcagtagtttatctgagttatatgaatgatggctcctttaatgaaattaccacatcactgatatattgtataagcttttgaagtttaaatatatgaaagattcattgtgaattttaatttcaatccatcaattcaggtaaagactcttaggttgtgtcgaaataacacacatattttgctatccatctgagactttattaatttgaaaatcctgagaatggaaatatcaaccatagggtttattcgggttgaattttagttcttttaaaactaacactcatacatttgaaatgaagttatgttaaatatatatattattattatgaattcatccatattgttaaatgatatgttaaatccatatcatatatttaatggtttttcaagtaggtgaaatgtctaaatatattaatactatgacattttgcaacttctttccttttaacgtagttcactggacttgctgacaactaatataatttcttaaatttttcttttccagtaaaatagcattctgtctcccccatcaccaaaaaaaagaacagttcattttacattttatgttactctttattccctagactttatgaatgactgtattcttggggaatacatttaaagttttgacttttaaataatgattttaaagatattttgtttcaaatacaagccgtccttcactgattatctgtttctacatagatatattaacaatctcagaaactacatttatcaatgtgataaagtttttatacctgcattataattaccattgactttttattgtagtaaaatagacataaaataacatttatttaaataattttaggtatgtaattcaatggcattaagtatatttacagtgtggtgcaatcatcaccatcatccacattttcattatccctaacagaaactctgtgattattaaacaataatgcctcattccacacttctctgcagcccctggtatctttattctactctctgcctgtattaattggcttactctaggtacctcatataaatgtaatcatttgtccttttttatctggcttatttcatttagcatagtgtttccaaggttcatccatgttgtagcatgtatcggaggtcattctttacctttagcttcttgattaatagtaattccaaacctgtggggttctttgaagatctaagaaatttgatgtaagagagatatctgactcaaaatgtgagagtgaataatattcctccacagtattgtccatagtgtcatatacttatgtccagattagccacaattctagtttgcttgtctttttgccattttctccttcaatttccagcaatcccaagtgctttccaatgtcccagctttgttttactttctactatcttgtccagttgaagccaagaaaccagaaaagtgttctgtgaagcttaacgatgcataactgtcatgagaggcatcgctaagaattcttataatatcattttgtgtaaccctctttaattaaagatatattcacctgggaataatctctgaaattattatgtattattggccaaggcttcttattctataagaaaataataataaaaagtagataattatttatacatttcctacattttgaaaaacagatttaattttaactcgctatccatcacttctagccagtgctttcatgtgaacaatttctgaataggtttctgtataacattattttgccaaacttatccatatctaacaaacaatgttctaaatcactgattttatcacttactggaataactacagtgtcactttttcagtacagctttttaaatcctaaatgctttttatatggctttagttatggtaccatataattcagcattgcctaaacttggaattgatagagaatgaactaaaaattcaaaaagagttttataggttttttaaatatcaattggaaattttgtgtgaccttttagcgacaacagttatgctcatattaatctcatccagcataaggtacatgtaattaagagacaatttcaaaagaaaataaagatttaagcctccttaagggtacgctgatttcaccatcctttactttcataaaaaagtgactttttggatccgtttcattaatagtaaaaaaatccactcctcagagcatgtcctttttttgagttcccagtcctctgggtgaagatgaagatgaagaaagagaagaaaaagaatataccctgtcactatacctaataacgataacactacaattataagcactatgggctgaaaccaaagttttttttccagaaattatttcatttaacgctcacaagagcttcttgagggaagtaattacatccccattttagagattagaaaaatgatttttggaaaggaaaagtaatttccccctaatcaatcagtctgtacattaaagacctgaaatttcaatctaaggttatctgactcttcactaattcttttcattgcttcatgaaaatgatttactgtatatgaaactgttattggattcaagtctggttactttattatgatgacataaatcaacatttgctaccagatatctacctttgatatctggattttccttaggactacattgtgtatatttggaagtatattttgtataccacaactgaacaacataatctattgaatagtccctgtctgcatgctgacataaaagtattctgcatttattgctacagtcaaagagttgctcagttatttttctggccttccattgaatttatgcccactctgtgttcacttatatcttaaaagaaataggaaaatctcaatatgtttgacagttttgtggcatgtactgcagaagggttcttaacagcttgtcaatagaattcagtattaattgataatcaatagaaaataagaaggaagttaacttccttcttatattcatgggcatttatgaatatcactatgatgcataatataatagccttctgatttactctatgtatttaaaatccaaggttttatttttctttgactacttcaaattctcagatgctttctccacaatattactatgtactactctaaaaatatgcatgacaatcactcaaccttattataacaaattttattttacatgctctttcaagatgatcattctttttgaaatcttatttgcctcctggaaactgtgacaatatcatttgatggatatggaacactgttaagagttcttcatagagaataagctgttcttccatgtagggaaatcattaagagtagatgttatttggaggtataagattggggcttatacgtctgtcaaatggtatggccatcacacatcatccagcagcctttgctttttatgatgttccttatttctcctgctattcatcagggaaaggccattttccttgtcagttttcccctaagactgttatatcagaaaaggggaatttagttgcttccatatttactttctcctaagagccacttagaaaattgggaatatattttctattggcttacctgctttatcatatttagaaaaatagtaaaacgaaggaattaatatattctctatctctcttactccgtttcactagctagatcttagcagtatagaattttctacaagtctttgtagagaatatttaaaataaagcataatacactcagtatctgaagctaaacttacccattatgactatcattctttgcctttccacaggaacaaatagttgtaaatatacctactttctgcttcttacgtcttggagtaagaaaatcacaaaaaacatttaaagaaatctcttagtcatatttccctgaaattaaatgtaaagagtctgtactccactaatgaatgacaagaagcgggttgaatggcataaaattaaattctcagtgttcctctctataactgtgtaaacaatgtgatctgctgtttttttggagtaggttcatcatttttacctgaaagttttaggttatgttatttttcccactagaaaatatgggtttaataataaaaatgtacacctaagaagaagtcttttaaaaaaataatcttatattgttataaaattgcttgggactaatccaaacctgtttcatttaaacctagcaaaaagaatcaaaatacaaatatcaaatttaaactaagtttagtctacagctaagcaaagagaatccaaataaaaatattaaattacaggagcctctggcttacatacaaaagaccaaattataatagagaagataaatgaggaacttgatatctacctttgaatttattacacattttcttcattaaaatgtataaatggcatctacatatattcagttgaatatttacaaaatctatagagtttaaggaataaaacagacataattaaatcagtagactaaatcatatatatctagtgtaattttcgttttttaaccttaatattttcttttctggtagtcgaacaaaaatctggatatatcaattaatgcatcaaacaactttaatctcaacattacgtggtctgtcggttcaacaggtaaaaaaatgttgatgtcatatctcttttacatgtgttcctatctggaagttgttctaacatgatctactgttaattaaatgtttgaaattttaaaaatgttatatgacaggattattttgctgttactggtaaaaataataagtagaaaaatgaatagagcttcattattttgttaactttctcctttattcaattaaaattagattggtaacaaatattatacactaaattaaatttttaagtggcagtgttataaaatgtgattttaattaagataaattgcttctttaatgactaaagagactgaaatttcaattatttgattcactattaaaactataaatttaattattaaccttaatatttatataaaacaatgaaattcttctgtacatgctgattacagtaaacatctattattgtcaagcttagaaaatataacccctcttgtcagcttcagtgctcagaggagttaaaaaactgatacataatatgtctttcataataaggttaataaatttaaattactgacttaaaaagtatatctgagaagctgttcagatttttatgttgaattatgaaatgtattcttactttaattttagttttacttttattctaaaaattttattggtatctattttctgtatcaaaggtatactgttgcataaatgtgctggaaattgtttcttttttatagaaaatttatggattcttagaaatttatatttgatttctgaaaattaaatcattatgctattttaatatgtagaatattatggatacatagaattcaagaattaagagctcttttgcaattcccaaatttatatattacattcaaaaaatgaaaattcaggcaaataggcattttgttactattagtgccaaacatacagtaaaatgttggcactatgggtttcattaaggaaaaattcgtaataacttgtactgttaatttgatagttatttctgaccagtaagaaaactgtaagggtttaaaaatgtgtctacaaaaatgtctataatacatttctaatcactttagaacaataattttagtatgcaagacatcacgtgttctttcagattcccagaccaaatctcagaaatttttatttatcagatttggagatgaagtcatggaatctgcatttaataaatgtacacaaggtgattatggaataagtggttagttaaaaattcaattacgcagtatactaattctaattatttttactattgattaaggtgaaagtattgctaagattgttggaaatgctttgttctattttattaacttcagtaaatatttattcagcactctatgtgtttaaccaattgagcatttagctcatgttttaaattgtggcctccacccaatttatttaaagcagtgatggttcaatttgtggtaagacaaataaattgattttttcccattttttaattggattgagacacacgaaaatatggtctgatttctttttaaatgctctgtggcattgtaaacagaatgagctcagtttctagagccacatatacctgagttccaactgcttagtagctataaacttggggcaaatgctttaatctttctgaggcttaggttgaaatctgaaaaatggaggtgataatacttctgggatattattggttttaaaaaagaatataaagtctctaagctagtgcctagtacatagcacttaatcagtggtagcatttttaaaaataatttttatactaaatttatttccattatatttatggcaaacttattttccttcattcaaaattataaacagtatattttgataattatttttataagagcaattataaaaaactataatatgcatttttaaattcataaagatatttcctaatattaattatttaaattatttacattttagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacaggtaagtgttaagagtatttacttctaatgaccataatatcattaagaaaagaatggtgcttttgtccaaagtgatgatatatgtacatttcctgacttgactaatacaaaaacatgcattgacctttgataaataaaggtctgcgaatgtctgtgatgatgaatttctctgtaaaaaccctcatggaaccaacaaactctatacttaaatttttcagtgattattatgtactaagcaatgtagccaactgaaatgttttggttttctgattaattatatactttaactgagggttaaataaatactgttctcatataaccccacttgaaattattttccgtttgagtagtcttatttttactttagcacattctgaaaataatctgatctttcattaaagattttgagttagcagtatttcagttacctctttaagtaattacctctcatcattaatttcctaatctgtactacatgtgtgttttacatttcatttttgttatagttagaggtagtctacttaagacgtcagatttacttctaggaaagaattggaatattctttctatcttatagtcaaggtttgtgttcttaatttatgttttcctgaaagaaaagcctatctattgggatgctgggatttgttcattcctttacaactgattgattagattgaatttacattagttattcgaatagcttatatatatcaatccttgttcatggcttttatgttttaaaatcttttaaagattttcagatcatcccttccctatatattagtaaattatagcatatgctctgtaactagaaatgtttgcaggttttatttatattaatttctatgtgatttgtggaaagaatgagtgatttttaaaatcatatgtttactggaaaaaatttttcttcttatttttaaggttgatgtaacacttaaattatggaaattattcaactgttcaggaaatatgaggataaattactattcagttcacttttgagaattaatttgagaaatttacttcttcattgtatagtgattgatttagatgctggtactgtcagaaaaatgccataaatatttgtttttaaaattttaacattaaggatgtgtaactttatttcctaagattcatagagaaatatttatcaaatttcacttcatttattcaattatgattgaaagggaaaagggttcatctatagcacttagtaattagttattaaaattgatatgattatattttaaattgcttcctatccttatttcttgtttatatacttttgaaaaaaaattacatagttattttagaatgtttttgaatacttaatggttaggaattaactttctaaattgggtttttttgagaacttactcttttggaagcaaaatcaaaatttgtgtaacgaggttgaaatactccactctcaaaataatacagtgtggaaaataattgagatggacaagatacgtaggcctaatttctcctctttattaaactcattatgcctatggaatatgttatattaaagcatggaagtattaatatatgtgtttatttataagactagaataaactttaaattataatattatacaaaacacagtaaaattattttaattatgattttaaatactggcagccatcattgtattccctttcaataagttcataagttttttagattccacctataagtgatatcatgcaatatttgtctttttgtgactgacttgtttatttagcatcatgtccttcagtttcttctatgttgtcacaaatagcaagatttcctgctttttaaaggcttaataatattccattgttatgtgtgtgtatgtacgtatataaatatatacatattatgaatatgaaacatatagatataaatcacgatttctttatgctttcatctatccatggacacagcttgcttctgtatcttggctattggaaataacgttgtaaagaatgtgagagtgcagctgtatctctgagatactgatttcacttgctttgaatatatccccagtggtgggattgctggatcattggtagttttatttttaatttttgggggaatcttcatacggctttacatgatggctataccagtttacattccaccaattgtgtgtaagaatttcccttgctccacatccattctaacacttgttatcttttgtatttttgataatggccatcataacagctatgaggtgatatcttattgtggttttgatttgcatttatttgatgattagcaatgctgagcaccatttcatatacctattggtcatttgtgtgtcttctgtggagaaatgtataatcaggtcctttgcccattgtttccattgagtttttgttttcttgctattgcgtttcatgagttccttacatattttggatattaacttcttattgaatagatcatttgcaaatttattttctattctgtaggttgccttttcagtttgttgattgtttcctttgctgtgccaggaagctttttttagtttgatgcagtcccacttgtttatttttgcttttgttgcctgaacttttggtattatatccaaaaaaatcattgataaagccaatgtcaaggagcttagtccctttattctgtttaggatttttataattacaggtcttatatttacatctttaatccattttgagttgatttttgtgtatggtataaagtaagaatccaatttcatcttctgcatattgatatcccagtgttaccaataccatttattgaagagactgtgtttcctttactatttattcctggcactgagtcaaagatcagttgacgctgtctatgggtttatttctagcctctctattctgctccattggtattagtgtatttttatgccagcaacttcctgttttgattactatagattcataatatagtttgaaatcagtaagtatgatgcctccagctttgttcttcttttataaaatttctttgactatttgcagtcttttgtggttccttttgaatttaaaaatttttttttctatatctgtgaaaaatgtaattggaattttgaaagcaattgtattgactctgtagaacactttgggtagtgtggccatttaaacaatgttaattcttccaatcaatgaacataggatattttccatttattattgatgttttgaatttctttcatcaatgctttataattttcagtgtacaggcctttcatttccttggttaaacttattcttaagtattttattctttttgatgctccagtaaatatgatttgtttacttaacttctgatttggagagttcattgttaatgtatagaattcaactgatttttgtatgttggttttgtatcctgcaacttgactgagttttttattctttttaacagtttattggtggactgtctagggtttcttgtgtatgagaacatgtcatctgcaaacagagacaggttttcttcttcttttccaatttggatgccttttacttttccttgtctaattgctttttctaggactaccagtcctatgttgaatagaagtagtgaaactgggcatttttgtttctttgctaaaattagaggaaaaaccttctgcatcttgccattgtgtaggatgttagctattggcttgttgtatgtgttctttattgtgttgaggtacattccgcttaaacctaatttgttggaagtttttatcatgaaacagtgttaataaactttgtcaaatgctttttcagcatctattgagatgatcatataatttttgtccttcattctgttaatgtggtatatcacattttgattcatgtatgttgaaccatccatgcattcctgggataaatcccacttgatcatgttttatgatacttataatgtgctgttgaatcaaatgtggttggctagcattttgttgaggatatttgcatttacatttatcaaggatgttggcctgtaatttttcttttttttccttatgttccctatggtaagctgtggtacaatagtattcatttttatttatttgttttccctcttactgttgctattatatttattttttaaagaacagaatacagcattattaactatagtcaccatgttgtacaatagaaattttcaacttagtccatctatttaactaaaattttgtgtccttttaccaatgtctctgaaatgccattgattttcttttcttgtagtctccttgcctgacttgggtgtcagggaaatgcttgccttacagcataagttcggaagtgttcactctacttcatctttttggaagagtttgagatggcttggtgttaatgctttaaatgtttgttagaattcaccagtgaagtcatcgattcctgagcttttctttgttggaaagctttttataattgattcaatcaccttagttatttttgatgtgaccaagttttctattttcacatgattcagtcttggaaagatgtatttttctaggaatttattcattcttttctaagttatttaatttgttggcatacaattccccacagtcatttcttatgaccttttggtatctatgatgtcagttgtaatgtctccttatacatttataatttgtttaagtcatgtctcttttttcttggttagtcctgtgcaaggtttgtcaatttttaaaattgttttaaaaaccaactgtttatcttttctattgtttttctattctgtatttcatttatttccaccatgatctttattatttccttccatctgctaactttgggcttcacagtttaacaattctattgccatttattgtaaggtagacctagtagtcatgaagttcttcagcttttgtttgtcagcttttatgtctccttcatttctgaagggcaacattgccaggtaaggtattcttggttggtagtacttttcttttagcactttaaatatatcatctcactcctcacctgtgaggtttctgctgagaaatctgttgatatccttagaagtattctcttatatgtgatgggtcacttttatcttcttctgcaattttctttttgagtttttacgattggattatgatgtgtcctagtgaagtcctttttagattgaatctgtttggtgatgttcagcttcatggatctagacatctgaatctctcataagatttgggaagttttgagccattattttcaagttaatagatgcctcgagtttagggactgttgtgggtgaaatagagcagggatggaagggagatatagaggtttttaaagagtatcaccagggatcttggtggtgttaggactcttcactgtcttgagtctggtggtggatgaatacatttttaaagcatccactaagtaaaatcaagtgttatataaacacaaagtaattatggatagttttcagcaaattttgacaaacaatgaaatttaaatttggtgatacaaacaagaatttctaaaatagccctttttgaataattacaaagtaaacagttcttcaataccctgctatcaaagtatggactgactaaccaaaggcattgacatcacccaggagcgtgtcagaaatgtagaattttagccctgtcgccactgaatgagatcctgctttttacccaaatccccctaggtgataatgtgcacagatgcttgcaagccattgtctaatagaaaaacaacaccaccaaaatcactccatttccttaatttgggaattgtctatagtattttcagttatgtctgtgaagatatgaaattgtttggaatttgaggattggcttaaattatggttcacagcataactcaatgaaatatttagtgttctttttccacttgcatctagattagtagagatatgatgtttttaatgtttttttcattttaatgaattttggagatgattgaaattagttaatatcatagtgaataatccttgtcttgttaaactactattttaattatgcatgaaatgctgctatcatttatatgcattatgtaatgtattttgataattaggcagctaatatgtagcaaaacacctttatacctatcagtttgtcagttatgatgtcagtaatgatgttctagttgttatcaatggaagtaatccagtgtcaatggattgcttcttaatcgttatagtatttaattctctgtggcatatctcacttatttctccatttggaataactgtttcttcaatttctgttgcatttgtctttcccatatttgtggtttcaatcaagttattcattcctctgagcttcaattacccaatctataaaatgaagattactagtggtacttaattatagggttatcatgatgattatgtgagatagttatgtgaaacaaaaccttacctattgcattgtaataattgttctaaattgtaaatagatgatcatcattttctttttcttcatcatcaccgtcaacgtcattggtatttaagagagctttttaatcttcttatcatttacctcacctttttaaaacctttggtgatttcccataatatttaagataaatttattcctttatcttttacttatctatattaggttgattacttctactacaagtcatacaaaaattataactgctcatcataacaaagacaaaatatttagtttaattcactcttgttttacatctttctatgttgagagtttaaatcgttgattttagaacttttcttttttctgatatatactctacagctataaattaacctgtatgcagtgctttgaccacattttacacattttggtatgttgtattttcatttttatttagtccaaaatatttcctgatttttcctgtgatattttctttgatgcataagttattccaaaatgttatttaattcatttcagggatatttcaggtgtctcctttttattaatttccaatttagttttcgctatggtcagagaaaaactatggttttaatcctttttaactttattaaggcttgtttttggcatattttttattttgcagaaaattcatgtgcttaaaaagcaaagtgccttctgctcttgttattcttttaatgtcagttggatatttatttgattcttattcaatgtctgagattattgctgattttctttctactttttctatcaattactgagaatattttggaaatttccagctatttttggtgttgtgtttctttttttaatattgtcagattttcttcttgttttttgaaattgtagtttttgtacatatacatttacataaaaggtccctttactgacccttttatttttatgaaatgttcttttttgtctttattaaatctgcatgccaaactactttcagctctccaaatatctatcctctgtcatttatttcattttgctgcttatttttacattctgtatttttatcttgcaaatgacctttctggccttaaccttttttttaactcttgcttagcttttgtctaattgtgaatataacctccccttatacctaactactagaaattactcttttcttacaactggcatattctttaacttatcacagtttatttatatttattgcttcacttatttatccattattagccctcaaactcctttacagagaaactacatatttttttgtatttttagtacttagctgaggtagctaaaggaatagtttttaaattgagagatgagtaatatatttctctggagaaaggaatgtacagataaaatatgctttcttatactcttaaaaaagttttaacatgcaatatagatagtttatgagtacaataaaagatttctcccttatatttacaaaaatcacatgggtttcttatttaataataacccaaattctttcttctcccaaaatgaaattttatagtaagttgttttgttaattaagattttgtgtaagaaacagaaatcgtgcatgactaacaaacagaagaaaatgtattgttagcataaggtgttgctaacaatatgaaagggaagaataaatcatcaggttttcaataagcagaaagctttcattccaacagttttcagtcatgtgcattagttgacattcttaactgggcatgcctgctatactgaatgaaatctcatgatttctccaacccatcctataaatattcactcaggatctaaaaatcttaagtgaatgagtccaactggcaaatttaggacacctgtctaacttcctcctgacccataatggtgcaagaaaaaaaattgtcctgggaagtagttttttggcttctctgctcgaagatatgggacttggattcacaaccccaataaggaaaaaaatatctgaagaaataattctttgtttggtcaggagatatttggtgatcaaaagtcaacaaatactcgttatcatggataaccttgatagaagcatattaatatctaataagactatccttctgaaatcagcatttccttattctaggaaaataatatgactataaaataatgtaattgttattaaagaaggcttcagttattgtgattcttaaaaatatttaattaatctgctgcaaagtgaattatatgtaacattttcatcaatgccaattctaatgtagatattcttatcttgcttccaggttacaattgcttgctttctcattgtcagtaagcagtaggtattaagaacacgggttctaagtcaaactactacctcaatttgaaattcttaaattacaagtgataggattgagaggaaggttttttgtttgttttttaagtcacagtctttccatttcttcctctgtcaaatgggagatgataatattgcctacctttattagtttttcttgctgtgtagcaaattatcacaagcttatcaggttaaaacaaggaccgtttattattttatactgtctgttggtcaggaatctgggcatgagttaactgccctttgttaaaccctgtactcagggcttcacaaggctgaagttatggtctgttgagctgccgtctcatctgaggcagaaggacttcttccaaggtcactagttgttggcagagttcagtatattgaagttgtaggtcttaggtttttctagttactgttagccaggggctcttcttagcctctagaagatggccgctgttccctgccacatggccctctctacaacatgacactgtgcttcttttaggccagttatacaatctcttttcctttaaatctctttcttcagtctgttataatggagactgataaaattcaataatcataggagtgactattctaccacctttggcatataatgtaacgtaatcaagggagtgaattttccattgtattcacagattccacctatacttaagggaaaggctttaacatatattgtattaaaatattagaaatgtgtatatgtttatcttttgaattagggtaaaaaaatggaaagttatttaaagtatatgaaaatagagtaaagatattgactgaaataatagtattatagttttgtcaaaatagttctttttatatcaaatatattttattacaatttatgttatcaaatatgttttcactcctactatctcctgtcctttcttctgtaaacccattagattttaattttacttttattaatttattctgtaaaacatttttatgtgaattacatgccaatcaagcaattattatggtataaagacttcatgtgggtaaagacagtgataataactgtttatttaaaaggcaggttttatcttttcagtctactagcatcattgttggcaaaattcactggttctattttcctttataattataaagatgtttgaggaatagatatctttgttaaggatttttggtatttacttgttaatactgtaccaaatttttgataactaattagaagttttttcttttactgttcctaaattatatgtgttgtaaaagtttcttgtagtaccatagtcttatatctatgaatggaattctagaaatcgagaaatgttttaaaatgtcaaatgcacaatatacttactagagtaggaaattttaagttggtggctatttgtacagaattaatcagacattaatttagccattgagatcctctgccatttaaacatattatttgattaatttatgtactttggaaagctgttttaatctaatgtaaatcaaacaaaagttttcttcattgtcttcaaactttaatagggtgttttatgttttaggttgccaatctctttagcatttaaatatccttaagatcctttagaaattctagtgactgtgagacatatagcagtgttatgtgataaatattccaataatatagtaattaaacagggaaaaaatctttttgttttgaaatgctgggaatcatgccattgagttcatttgcatgtttgtaatatgagattttattttggtagcacttgttcttcatgatttataatgtcatgcaattaaatcttgataataaaaaatagaaaaaagtactactgtagcggtagtgctaataacttcaaaaaaagtgtattgaacttaagtactttgtattctacaatagtgctgttcatcaacatttatatatcacagtttaaattaaattagattgactctcaattacctgtttctgagcaaactggctttgacaattcactattatatcaatctgcaaagtgatgtcataatttagattagattttttaatgagaatgatgctaggaattattcttcactttgcaattctaatttccattctatactggttaatttccttactagcattggttaagttatacagaacaaaatagaagaagaagtgaatcctagtgctgatgtctatacaattttatcacaaataaattagcattttcaacatagatgagtcatttgaacacacacacacacacacacacacacacaaaacagaaaactactggttaagtagatattaaagaggatgttttaacttatacatatgatttgaaaagtggctatcataaaaatgtgctgatggagttgcccttgtatatatatattttttaaattgacacagaacacttttcgttatttgtggttcttgtcttttaaattgttatatgcttgaagaagttatcatatatattttcaaatacacttttttcttttttaaaaaagtttcaattctttttgtcatttaaccaaccaaggtaacataaattcaaaaggtagtattagaaattgttaattttatcagttaaagatgtattaactatactaattagaaatataaatgtgaatgatataacaaatatgtaagaaacacatatagaggagaatggaagattttctaatagctataaaataatactggctatgataggtacaaatgttctcaaaattctcacaaggaagatatattacatttacactacattgacagaattgagtagtgaaaccagagaccatattgcccacaaagctgaaaatatttactgtctggttctttacagaaaaagttcgttgactttttatgcaaaatgctcttatctaatcccttatccagagctattctttacaaggaataaaattgtttgaattaggtgagatggtataaatgtaaaatctgcttttctaagaaaatttcttatgacaaacattttcaacttttccagtggtaaaataaatttgagtaaagaagatttttcatttctttatattataaatttttataaagtcattaattatattttgaaatctaatgaaactcttctaaaaattttaatgcggttttgttaaatattcataataatcccatagatatttttagatggttgcccttgtaatatagtattcttttataaactaccctggtttttatataacatattgtaaacaattttagttttaatataatattaattaatgtttttaatactataagaattttttcagatcatatacttccatagtctgttactggaaatttggagttatttttgttttaaaaaagagcaaggtgatgaatatctttgtgtgcattcatcttctattttagaaaattatttcttttgcacatatgtccccaaattaaattattgggttaaagtatataaacaaatttatgattgtatattatgcactaggcattattcaaggtattgtatatgatttagtgctgttattcctaacttataaaatatttttatctaaatttttataaatgaacaaaataacttgttgaatttcatacagtaggcaattgaattgagatatgagactggtcaatttgacaccagatcccattctaccactattaactcacacttctttattttactatcattttattagtattaatattaaggctgaacatttttctatttataaaatatttactgagaagaatttataaacaaacatatttataatcttatatttatatctcaggacagcttcctgaggatattttgttttagctctagacacgcttccattttaaacctaaactggaagtgtgtaaaagttagtcatttgaaaaaaatataactatacttgatttgtttgcaattacaattaagtattacctcttggggtttgttaagaacttctacttcagaaattgtttaaaaaatgacttaatttttggcaaaggtattaaagtatgagtactatattttgggtttgatttgtgagctactgatacctttaagaattcatcaatatccataatctcagaaggcagtatatttacaataatggatcaaatgaaatattaatatataatgacttagcatagcaaatatttcagaatctctcaatagataataaaggtatatgtgacttaagattatacttctacttggactcgtgtttcatattgttatataatgttactagaatcactaaataaatattgaattaatgcagaatagaggattacagcaattctttaaatattgccttacaaatgaatattcagcacgcagtgggttctatgtgtaaatctgtaggttgaaatttagaatttttactaatgtctttatttttgtaattgctctacaagagttgcttattcaaatggcaaagtaaacacttatgtaagataatgtaaattgtggtagtttcaaaatttccatgttcttttaacttttatgtaatttgacgagaataaaaatgcttcttttattaatatatttataatactgaatcatatgtttctccttattttgtactttgatgattggataaacaaatataataatttttaattaattatgtagtaatgaatttcttcattaataagcatttattgagttattcactttgagtagtctaataaattacagtaaaaacacatataaaaatagaattaataaagtttgaatcagtcccaagaattagagctttatttaagaatcattatttgttgcttcatataggaagctcagagaattgtaaagtagaatccaaaatttatacaaaagcggactttattctgtactgaatgttgttagtaactaaaatttaggcataaaagaagttagaggtgaaggtcttaaatattctttgttttagcatatacctagatattgaataattcgtttacatattctttgcttaggttcccagttctgtactaaccgtaaggtaagaaagagtaggggataatctgtttgctaatagaagagtatatattttatttgttaagtaaataaaatggtatgttttaacatttctggacagtttttgcttttcctaaaacattttggtcctatcaaattataaatgaaaattattatttgtaattattaatttaccaacccctgtgctaatggaaaaagaaacttattgcatgttgatctcctatggaaagacatctgctcttacaagtcagatatgaaattagttccatcatttatttcatatgccttcataaatcaacaatagtttatataatgaaagaagtcaccagaaacttgtattgcgtaaagaactgttctcaaactttcacgctgggaaaaaaattgtttagaaagagagggcatcttgactgaagctttaagcaaatttaggaaattataatgatgttgtctaataattactagagatatagcaaatatagattttcattgcttatattttatttaattctttcattccttcaactttcagcatacattttattggtcatttgtgcatatacaattttggcttattgccaaatatatttaatataatttgatgtaacaacaaaatataccacatgactatatgtacagacctaatttacaaattgtaactcagttatttctttagatttatcaattttattatacttaattttcataaaatctagatgttagaagaaatcgtgtaattatatgtatatgttgttttaattatttacacatggtactttaaagttaatgcaaatgtgattaaatgtgagtgttatgattccattttacttatgatttttaaagcattttatatgctaggtcaatgtttttgatagagtctacatgaaataaacttattgaaatattcattatttttgcacactctaagaaggaatcaatctcatatttgcccatgtttttagagtttgacatgcttttaggctaattgtttgtgagactgtaagaagcagagagagggccactactcaagtgaaatattcaggaagcatttgtaagaatttgtaagaatacagttgaataaacctacactaggtctctcaaaagcagagtgccttatactccctttcttgggataatggtaataattttgaaatgcaattgaagagactctgtttctgattatctttttttttttcagtaaatgtcaaatcttagatctttttcatatcttttaaaattctaaatctatatctcattgatattaggttatgaagtattctgcaaattaccaaatgctgttattaaatattatgttttttcattttgttttatcatattttgaataatcttccaattcactctctacttacagattatgctattttatattttaattttgagattttatctcaggtcttgtttgtgttcactcttttacagttaaaaaaaccaagaatcagtgtattaatatatatcaaatgcagtggcagaatatttaatttatcttaaataaattaaataggataaggtatcaagttacagtcttcatacttttattatatacagtatactttttaggactgtgtgtatttaaataagtcatacaatttttaagggtcatcttattttcccaatgagtgcttctttaacaccactcattgggcaaatgccttctttgaattcccatagcatcttagcttatatttattcttatagtatttgaacataaactctacacttaatatttgaatatataatatgtgaattgcctgtagttgtcttctgaggaatactacaaatttctctcagagttaaccatattttacagttcaaaaatctttccgtttttagactattcaaataatatgtttgttttagtgctttaaatttgctctatctatgctaattatgtgggggagactaagaagaaatgtaagatgtttattgacctaaagaatttaaattaggtaaaaatcaggagcatgcaatagggagaagattaattatgaaattgagagaaggagttggcaagaatcactatgtgagcgaaaatgagtgtaagctattaatgagccatcacttgatcatggtctgtttttttgtgtggtgttgctagtatttagtaggtgtgcattgatattaataagtgatattgataacttttttcctgtactgtctatgtcagatgtggcatttgtgttataatttcttcataaaaagaattaaaaagtgttccttcatttttattgttttataaaaatatatataacatttaaactacctggtctttgaaaccatagtagaatttccctatgaaacctctggtactggtattttttgtagagtaatttctttataacttcctctatttcatctacagaatcttttccatttaagctacttttttctaaatttatttatttctaattaacagataaaattgtatttataatgtaaacatgatgttttgaggtatatatacattttggaatggttaaatctagctaattaaaatatgcattacctcacatagttgtcatttctgtggtgcaaatgtttaacatccagtctctcaacattttttgagaatacaacatattatcattaaccttagtgaccattctatacaataaatctgttaagtgtattcttcctatgtgactaattttgtatcctttaaccagtgtccctccaaaccccctcctcaatcacccaacgtctttattttttttaagtttataaattattttattgtaagcattgctacaattatttgaatcttctagtgttacacattacaaatgaagatctttctttttttattatactttaatttctggggtacatgtgcagaatgtgcaggtttgttacataggtatacacgtgccatggtggtttgctgcacccatcaacctgttatctacattaggtatttctcgtaacgctatccctaccacagccccccaccccccaataggccctggtttgtgatccccgcccccactcctgtcaatgtgttctcactgttcaactcccacttatgagtgagaacatgcggtgcttggttttctgttcttgtgttgctttcctgagaatgatggtttccagcttcatccatgtccctgcaaaggacatgaactcatcattttttatggctgcatagtattcgatggtgtatatgtgccacattttctttgtccagtctatcattgatgagcatttgggttggttccaagtctttgctattgtgaacagtgccgcaataaacatctgtgtgcatgtgtctctataatagaatgatttataatcctttgggtatatacccagtaatgagattgctgggtcaaatagtatttctagttgcagttccttgaggaatcaccacactgtcttccacaatggttgaactaatttacactcccatcaacagtgtaaaaagtgtccctatttctccacatcctctccagcatctgtcgtttcctgactttttaatgatcaccattctaactgccatgagatggtatctcattgtggttttgatttgcatttctctaatcaccggtgatgatgagctttttttcatatttttgttggccacagaaatgtcttcttttgagaagtgtctgttcatatcctttgcccactttttgatggggttgtttttttcttgtaaatttgtttaaattccttgtagtctggatattagccctttgtcagatggatagagtgcaaaaattttctcccattctgtaggttgcctgttcactctgataatagtttcttttgctgtgcagaagctctttagtttagtttcccatttgtcagttttggcttttgttgcaattgctttttatgttttagtcatgagtctttgcccatgcctatgtcctgaatggtattgcccaggttttcttctagggtttttatggttttaggtcttacatttaagtctttaatctacctttagttaatttttgtataaggtgtaaggaagggatccagtttcagctttctgtatatggctagccagttttcccaataacatttattaaacagggaatccttcccccattgcttgttttttgtcaggtttgtcaaagatcagatggttgtagatgtgtggtattatttctgagtcttctgttctgttccattggtctatatatctgttttggtaccagtaccatgctgttttggtaccatagccttgtagtatagtttgaagtcaggttacgtgatgcctccaactctgttcgttttgcttaggactatctgggatatgcaggctcttttttagtcccatatgaaatttaaagtagtttttttttccagttctgtgaagaaagtcaatggtagattgatggggatagcattgactctataaattactttgagcagtatgtccattatcacaagactgattcttcctatcaatgaccatggaatgtttttccatttgtttgtgtcctgtcttatttccttcagcagtggtttgtagttctccttgaggaggtccttcacatcccttgtaagttgtattcctaggtattttattctctttgtagtaattgtgaatgggagttcattcatgatttgactgttattggtgtataggaatgcttatgttttttgcacattgattttgtattcggacactttgctgaagttgcttgtcagcttaaggagtttttggacggagatgatggggttttctaaatatacaatcatgtcctctgcaaacagagacaatttgacttcctcttttcctatttgaataccctttatttctttctcttgcctgattgccctggccagaacttccaatactatgttgaataggagtgatgagagagggcatccttgtcttgtggctgttttcaaagggattgcttccagtttttgcccattcagtatgatattggctgtgcatttgtcataaatagctcttattattttgagatatgtttcatcctagtttattgagagtttttagtatgaaaggctgttgaattttgttgaaggcctttcctgcatctattgagataatcgtgttttttgtcattggttctgtttatgcgatggactagtttattgatttgcgtatgttgaaccagtcttgcatctcagggatgaagctgacttgattgtggtggataagctttttgatgtgctgctggattcaatttgccggtattttactgaggatttttgcatcgatgttcatcagggatattggcctgaaatttttccttttgctgtgtctctaccaggttttggtgtcaggatgatgctggcctcttaaaatgagttagggaggattccttctttttctattgtttggaatagtttcagaaggaatggtaccagttcctcttggtacctctggtagaattcggctgtgaatccatctggtagtggactttttttggttggtacgctattaatcaatgcctcaatttcagaacttgttattggtctatttagggattcaacttattcctggtttaatcttgggagtgtgtatgtgtccaggaatttatccatttcttctagattttctagtttatttgcatagaagtgtttatagtattttctgatggaagtttgtatttctgtgggatcggtggtgatatcccctttatcattttttattgtatctatttgatccttctctcttttcttcttcttagtctggctggctagcggtctatgtattttgtggatcttttcaaaaaaccagctcctggattcatggattttttgaagggtttttcgtgtctctatctcctttagttctgccctgatcttagttatttcttgtcttctgctcactttttagtttgtttgttcttgcttctctagttcttttacttgtgatgttagggtgtcaattttagatctttcctgctttctgttgtgggcatttagtgctataaatatccctctacacactgctttaaatgtgtcccagagattctggtatgttgtgtctttgttctcattggtttcaaagaccatctttctttctatcttaattttgtcatttacccagtagtcattcaggagcaggtttttcagtttccatgtagttgtgtggttttgagtgagtttcttaatcttgagttctaatttgattgcactgtgtctgagagactgtttcttatgatttccgttcttttgcatttgctgaagagtattttacttacaatcatgtggtcaattttagaattaagtgcaatgtggtgctgagaagaatgtatattctgttgatttggggtggagagttctgtggatgtctattaggtccacttggtccagagctgagttcaaatcctggatatccttgttaattttctgtctccttgatctgtctaatattgacagtggggtgttaaagtctcccattattattgtgtgggagtctaagtctctttgtgggcctctaaggacttgctttatgaatctgggtgctcctgtattgggtgcatatatatttaggatagtcagctcttcttgttgaactgatccctttaccattatgtaatggccttctttgtctcttttgatctttgttggtttaaagtctgttttatcagagactagggttgcaacctctgccccttttttgctttccatttgcttggtaaatatttttccatccctttattttgagcctgtgtgtgtctttgcacatgagatgggtctcctgaatacagcacactgatgggtcttgactctatccaatttgccagtctgtgtcttttaattggggcatttagcccatttacagttaaggttaatattgttacatgtgaatttgatcttgtcattatgatgctagctggttattttgcctgttagttgatgcagtttcttcatagcattgatggtctttgcaatttggtatgtttttgcagtggccggtaccagtcattcctttccatgtttagtgcttccttcaggagctcttgtaaggcaggcctgttggtgacagtctctcagcatttgtttgcctgtaaaggattttattttctccttctcttttgaagcttagtttggctgtatatgaaattctgggttgaaaattcttttctttaagaatgttaaatattagcccccagtctcttctggctcgtagggtgtctgccaacatatccactgttagtctgatgggcttccctttgtgggtaacccgacctttctctctggctgcccttaacatttttttccttcatttgaacattggtgaatctgatgattatgtgtcttggggttcctcttctcgaggagtatctttgtggtgttctctgtatttcctgaatttgaatgttggcctgcattgctaggtcggggcagttctcctggataatatcctgaagaatttttcccagcatggttccattctccttgtcactttctgctataccaatcaaatgtagatttggtcttttctcataatcccttatttcttggaggctttgtttctttttactcttttttctctaatcttgtcttctggctttatttctttgagttgatcttcaatctctgatatcctttcttccccttgattgattcagctattgatagatgtgtatgcctcacgaagttcttgtgctgtgtttttcagctccatcaggtcatttatgtttttctctaaattggttattctagttagcaattcatctaaccttttttcaaggttcttatcttccttgcattgagttatgctcctccatgctcctttagcttggaggaattagttattacccaccttctaaagcctacttctgtcagtttgtcaaactcattctccatccagttttgttcccttgctggtgaggagttgtgatcctttggaggagaagaggtgttctgttttttggaattttcagcctttttgggctggtttctccccatcttcgtgtatttatctacctttggtctttgacgttggtgaccttcagatggggtctctgagtggacatcctttttgttgatgttgatactattcctttctgtttgttagtttttccttctaacagtcaggcccctctgctgcaggtctcctggaatttgctggatgtccactccagactctttttgcctggttatcaccagcggagccagcaaaacagcaaagattgctgcctgttcctttctcagcaagcttcgttccagaggggcacctgccaaatgccagccagagctctcctgtatgaggggtctgtcagcccctactgcaaggtgtctcccagtcatgatacactgggggtcagggacccacttgaggacccacttgaggccgtctgttccttatcagagcttgaacgctctgctgggagatctgctactctcttcagagctgtcaggcagtgatgtttaagtctgctgaagctgcccccacagctgccccttcctgcaggtgctctgtcccagggagatgggggttttatctttaagtccctgacttgggctgctgccttttttttttcagagatgtcctgcacagagtggaggaatctagagaggcagtctggccgcagtagccttgctgagctgcagtgggctcagctctgtttgaacttcccagtggctttgtttacactgtgagggcaaaatcacctactcaagcctcagcagtggtggacgccactccccccaccaagctggagcatcccagttcaacctcagactgctgtgctggcagcgagaatttcaagccagtggatcttagcttgctggggtctgtccgggtaggaccagctgagccagatcacttggctccctggcttcagccccctttccaggagagtgaatggttcttcctggctggcgttccaggtgccactgggatatgaaaaagaactcttgcagctagctcagtgtctgcccaaatggctgcccagttttgtgcttgaaacctagggccctggtggcatagacaccagagggaatctcctggtctgctggttgcgtagactgtgggaaacgcacagtatttggcctggagtgcgctgttcctcctgtctctcatggcttcccttggctaggggagggaaatcctctgacctcttggcttcccaggtaaggcgatgccctatcctgcttcagctcaccctctgtgggctgtacccactgcccaaccagtcccggtgagatgaacggtgtacttcagttggaaatacagacatcactcaccttctgtgtcaatctcgctgggagctgcagcctggagcagttcctatatggccatcttgctagcaaatcgtcaagctctttatttttaacaggatttctgaggtttttgtttagaagtctgcaaagtgatccctcattctattaacttgtattgtttcaatggttatttctttttttggaggtgggcattcgtccttgccttcttgatcattataactgacaatttacttacattgctaatgttttgaaaaattagagtttgatttaattaggtctctcattcttcatattcttgcatcattaatgcttactttcatctttgttatagtatttccttttttggctttctattagtttactttgaggttccttttatcatttctagagctttatatttcatttattttagatattttatgtgtatattttatatttatatttcatttactttatatattatatatattataattcatttcttttaattctttcatttttactaaagtgatttttttttttttttttgagatggggtctcactctgttgcctaggctggagtgtagtggcacaatcttggcccactgcaagctccgcctcccgggttcacaccattctcctgcctcagcctcctgagtatctgggactacaggcgcctgccaccatgccctgctaattttttatatttttagtagagacggggtttcaccatgttagccaggatagtctcagtctcctgaccttgtgatccacccgtctcagcctcccaaagtacagggattacaggcgtgagtcaccgcgcctggccttactaaagtattttttgatggaaatgttcattagcttcattttgtcattcatatgtatatgtaaaacaacatcactttgtactccataaatatatagaattataacttgacaatttacaataaaataaaaaataatctttttttttgctttgtgaaattgttatttatttcttatcaacttttattttagatttagtggtagacatgccagtttgctacatgggtaaactgtgttttgtggggatgtggtgtacagattatttcattgcccaggtaatgagcatagtacacaataggtagttttcaatcctcaccctcctcttactctccatcctcagataggcccttgtgtatattgttcccttcttcatgtctatgtgtactctatgtttagcaccttctcataagtgagaacatgcaatatttggttttctgctcctgcattatttcgcttaggatattgaccttcagctccattcatgttgctacagaggacatgattttgttctttttatggctgtatagtattctatagtgtatacgtaccactttttctttatccagcccaccactgatgaccatctaggtttattatgtgtcttttctattgtgaatactgctgtgataaacatacacatgcatgtttctttatggtagaacgatttatattcctttgggtacatacccaataatgggattgctgggttgaatggtagttctgtttaatgttctttgagaaattgccaaactgctttccacactggccaaacaaatttacatttccaccaacactgtataagttttctcttttctctgcaaccttactagcttctgttattatttgactttttaatagtagatattctgactagtgtgaaatggtattattgtagctttgatttgcaattctttaataattagtgatgtttagcatttttttcttatgcttcttggccacatgtatatcttcttttgaaatgtgtcagtttgtgttctttgcccacattttaatggggttatgttttttttggttgttaatttttaagttccttataaattctggttataaatccttagaccattgttggatgcatagtttgcaaatattttctcttattctataggctgcttaatatgctgatagtttcttttgttggaagctcttcagtttaatttttgtcaaaaattttgtcaatttttgtttttgttgcaattgcttttggcatcttcatcatgattttgtatcctgaaactttgctgatgttgtttatcagatctaggagcttttggtcagacactatgaggttttctacatatacaatcatataatttgtgaagagagatagtttgacttcctctcatcctgtttggatgcatttcattcctttctcttgcctgattgctgtggccaggacttccagtactgtgtcgaacaggagtggtgagagtaggcatccttgttttgtcccagttctccaggggaatgctgctattaatagcttttgcccattcagcatgacgttggctgtgggtttgtccttgatggctcttgttatttcaaggtatgttccttcaatgcctagtttgttgaaggtgttaacatgaaggaatgtttggtttaattgaaagctttttcttcatatattcagatgattatgtggtttttgtttttagctctgtttatgtgataaatcacatttattgatctaggtatgttgaaccaaccttgcatcccaaagataaagcctacttaattgtggtggattggatttttgatatgctgctcaattcactttgctagtatttttttgagaattcttgcatcaatgttcatcaaggatattagcctgaagtttccttttttcattgtgtctttgccagattttggtttcagaatgacactggccttgtagaatgagttagagaggagtccctccttctaaaattttggaatggtttcagtaggaatggtgccagctctttatacaaatgatatattttgtctgtgaatctgtctggtcttgggttttttctggtaggtagactttttatttctgattccattttggaactcattatttgtctgttcagcaatcaatttcttcctcgttcaatcttgggtcgttgtatgtttcaaggaatttatttcttctaggttttctagtttgtgtatatagaggtgttcatagtagtctctgtgggtgttttgtatttctgtgggaatggttgtagtgttatgtttgtcatttatgattgtatttatttggatcttttttctttagtagtatagctagtggtctatgagtcttatttatatttcaaagaatgaagtgggtttgttaattttttgtatgattttgtgtctcactatccttcagttgagttctgattttggttacttcttatcttctgctagctttgggttttgtatgcccttgtatatctagttcctctaggtgtgatgttaggttgttaatttgagatcattctaactttttgatgtggacgtttagcactaaaaactttcctcttaacactgctttaactgtgctccagagattctggtgttttgcatctttgttctcattaatttcaaagaattttctgatttctgacttaatatcattgattaccccgaagtcattcaggagtaggctgtttaacttccatgtgattttatagtttcgagtgatcttctaagtattgatttttatttttattgcactactgtctgagaatgcagttggtatgatttcagttttttttttttaatttgctgagaattgttttatggccagttgtgtggtcaatatcagagtatgtgctatttgcagatgagaagaatatattcttttgtttttgagtggagagttctgtagatgtatgttaggtccacttgatcaaatgtcgagttcaggttcggaatatttttgttagttttctgccttgatgatctgtctaatattgccattgggatgttgacatcacccactattattgtgtggttatgtacatctgtttatatgtctctaagaacttgttttatgaattgggtatttttgtgttgggtgcatatctatttaggatagttagttgttctttaattgtaaccactaccattgtataatacccatctttgtcttttttgatcattactggcttagtgtttgttttgtctgcaactataatagcaacccttgctgttttctgtttttcatttgctcggtaggtttttctccatccttttactttgagcctatgggtgtcattgcacgtaagatgggtcagcatgtaagctggttattatgcagacttgtttgtgcagtttctttatagtttcagttatctatgtacttaagtgtctttttgtggtggaaagtaatggtcttttttctccagatttagcactccttaaggatcttttataaggcaggtaatgaattccgttatttgcttgtgtgaaaagtatcttattttcccttcacttatgaagcttatgaaggaatatttggtttaattgaaagctttttctctatatattcagatgattatgtggtttttgtttttagctctgtttatgtgataaatcacatttattgctagatttttctccatccttttactttgagcctattggtgtgatgtgaggttgttaatttgagatcattctaacttttcgatgtggacgtttagcactataaactttcctcttaagtttggttggaaatgaagtttttgatttgagtttttattctttaaaattgctgagtatcagctcccagtctgttctggcttataaggcctctgctcaaaggtccactgttagcctgatggggttccctttgtagatgacctgccccttctctctagctccatttaacattttttctttcatttctaccttggagaatatgttgactatagtcttagggatggtcttcttgtgaggtatctcttggggttccctgcatttcctgaagttgaatgtggcctctctagcaaggctaggggagaaagttgctggctttctctccctgtctttcagcgacaccagtgagttgtagatttggtttctttacataatcccatatttctcagaggatttgttcatttttttaattctttaaaaaacattttttttctgattgagtttgtttggagaaccagtctaaaagctctaagatgtgttcctcagcgtggtccattctactgtgaatacttgtgcttgcattatgaaatttttgtagtgtgttttgcaactctatcagatcagtttggttctttcttataacggccattttatctatcggctcctgcattattttattgaaatccgtaaattctatggatgggtttcatctttctcctgaatctcctgaatctttatgatcttcataggggatctaagtgcagagtgcaaaaagcctgtggcagatatgtgagtccatggggactatcactcacttatcatttccccatggtggaggacatcccttggctcaatgccacttttgggcgggcaatagttctgtctcactcttttctgttctccatgggtcacattttttccttgatgaatcccaatgtgttcacctagatgttctagttgaagggctagtgttgctcaccactctcttctctccatgaaagtggtgcacactaattggttctaatcagccatcttgtaaagtctcagtgtaagttaagtttactcttttttttcttttttttttgagatggagtcttgctctgttgccatgctggagtgcagtggcgcaatctcggctcaccgcaacctctgactccctggctcaagcaattctcctgcttcagcctcccgagtagctgtgattaggggcatgtgccaccatgtccagctaatttttgtatttttagtagagacggggtttcgccatgttgtccaggatggtgtcgatctcctgacctcatgatccacccgcctaggcctcccgcagtgctgagattacaggcgtgaggcattacacctggcctactgcactttttaaaaatcatcaaagcatgaaattatctatgagtgagtgaaaactcattagaaagagtcttctcaaagaataaattactttatgccattaaattgataccaaatctgaatttgactagtgctcagcaacatcttatttcccacattagatttaatttaaatatagtaattacccatgacttaagaaaataatattttaaataccatagtaaaatatatgtccgatatttattttctttgcctattattattattttgcctaatatactctggtataaaaggccttccaaataccacagggtagaaaagatttttaaagttacaaataaattcctataaactatatatggcattacatgattttcaactttgtttttagctatattggataatcataagatttcattttttaaaaaattgaaaagccatgatctctcaacttgggttttaaaatttatcatgttttgattataatgagtcttaagctctatgatgccatttttttatgtagttaattaatggaaacctatgcttatcagggaaagacatcagcaattgtggggtacctaataaatcacctttgtaagatttttcttctggaaagcacctcactgttactacattctgtttcattagtctaacagtgaaaacagaatagcaactatctcttaaaaattagatactttctatatataagtatatactttaatatacaaaatataaatatggatatcaatattttaaaattttagtcgttttgtttccttaactattaatgtatttttataatgcaaatgttttattactcatttaataggaatatatatgcattaaaaaattaatgttttgggtagtagaacatgctttactcttagactgttggaaatacttgctactttcagcttttagacataacccaaatttctaaagttttaaagataagactgaatgataaagtcaatttagtgcatttcctttacaaaatgagtacctttggttacttaacacagtatgcagaaaaagataggttatgaaaaaattataatttctataaaatggtgttaaaagcaaaaattgctattatgaatctttgatttgtgaattgaaatctgagaatcttcaagaaatctcataaatatgcaaatactataattaaatacaggtatcattataattactaatttttatcttgtcattttaaaggttccgttttgttttctaacatttataacaatatttttttgacaaaaataggttttaacttcaagaaattatactcttcaagaaactaactgaagagattgggctcaattttaatgtagatataaaattctacatattttaactggtataatctttgtgaaaaagtaatgcttgttttctagtacagcttgacctttagctaaaatgaaactattttaagagtttttactttgaacattgagtgtgtgaacaccgaaaagatgagacaggtgtcagttaatttagaaagcttatttgccaaggttgaggacatgcacctgtgacacagcctcagaaggttttgatgacatgtgcccaaggtggttagagcacagtctggttttatacattttagggagacataagacattaacatatgtaagatgaacattgattcagtctggaaaggcaggacagctggaagcaaagatgggaagacttgaaggagggagagggttctaggttataggcagataagagacaaatagttgcattcatttgagtttctgattaacctctccaaaggaggcaatcagatatgcatttatcttagtgagccgagggatgacgttgaatgaactgggaggctggttggccctaagcagttcccagcttgatttttccctgtagcttagtgatttggaggcatcaaggtttattttcctttcacgtttactcctttttccttttaatcatcttttggagaaagcatttcagaagaaaataagtttctggtctcaggttttgtctgatcttttatggctaggatgctttattcctagacaggtaggtcccaagttattaggaaagctcattttttgcaggtgttgaagacttatgtttatgaagagaaaatagggggaggaagggagaaaaacaaccacaaacaaaggaacaatcctggataattgacgtaggccacagtactttgaagtccatccatcagtaggcatgtatgaatgtggcttatgtatgtaaatagattgctgttacattttctgaagtttaagttgtttagctttagtttgcagggcttcacgaaagcacagcttagttttcagtgactccaaattaggaaatatggggaaaaaataaggaaaacaaattgaaaacattagtttgcagatttgtagtcaagaaaaattagaatttggtccaaaccttagaaaataataaaaattgaaaaacattaggcaagactagaatctaacatcaggtgtcctatagtttttgaaatttttttttctccagtttcccgtgtttattaaagacaaatcatggtaggactgatttgttttattatacttgacctcattatttgtatatagtgcagcaagaataattttttttttgaaatggagttttgctcttgttgcccaggctggagtgcaatggtgtgatctcagctcattgcaacctctgcctccggattcaagcaattcccagccccagcctcctgagtagctgggattataggcatgtgccaccacgcctggctaattttgtatttttagtggagatggggtttctccatgttggtcaggctggtctcgaactcccgacctcaggtgatccgcctgcctcggcgtcccagagagctgggattacaggtgtgaaccaccacgcctggcccaaataattattttttttatgtaggcttttaaattggctttgatggaactttgtttcatagcagaaatttcaggtaagactttttttttttttttttttttttttgagatagagtttcgttcttgtcgcccaggctggagtgcaatggtgcgagctccacttactgcaacctctgcctcctggattcaagcaattctccttcctgccttagcctcccaagtagctgagattacaggcacccaccaccatgcctggcttatttttgtattgtttggtagagacagggtttcaccatgtttgccaggctagtcttgaactcctaacctcaggtgatccacctgttttagcctcccaaagtgctgggattacaggcgtgagccactgcgtctggcccaggtgagacttttttaaagctgtgcccagccatggatttgtaccattaaatacctatgagttgggtgaattcctcttctcttgaggtttcaggataaacttggggctcatgggcctattagaaagtgacattattttacttaccacaggttatgaaccctgttacagggactgtagacaaggtataaggccagtttttccatggggctgttattggctccataagttgtttgattccttaaaagaaagtacatcattcctgttaatgctttggtaaaaataacccatttcttcagtcatgtactgttacaaattaaaacagattcttattgcacattccatagttatatggaaataactatattgccataagttaagaatactaacaagtagtttttaaattctgtagaaatcaggtagagagaaacaaatgttgtttataggagtatactaaattattagaagctattaatagctttaaagaaaagttttcttgacattgaaaaaacaaaacaaaggattagcaatgttttaagcaaaaagttaaaaagagtactgtagtcatctattagttcagtccatgcagttaattcctgttctgcttgacatttatgaacatatcagctctccctgtgtcctgaaattttttcctctatttacatatcaaaatcttcaaagttatcagagattgcattcaagagcacctgttagagttttatagctgattataaaacccccttctaaagaggactaaaagaagacaacaattgtccttggattacaaaagttttaagatagccaaagtttaagacacaattaagtaaatttgttatgtctgtggcacacaataatttaacataacaattacaattattactgataatgtatactaagttatatcagaattatgggagttttccataattttggaatacatatcaataatgtatttatacaaatacagctcaaagaaaaccacgtgccattttgtacttgacaatgcttcttgtataatttttataccaattaagccaaattatgttttttttggactctagggaccctaatatcttaaaggattaattaggttagaaaaagacataatttataatttgattttggaaagtttgttaaatatcaaaggtttaaaacacttgatatagcaggttattgtaaaataagttattcattcaaccaaagtgataactcaaggatttttaaaaagaggcaaaaacccttattttttgagagaggagacttaattttacaaacaagaagccctagtaaaaatagcatgaagccaattaatttttttttaattttataaacaatttataaaattttaatcctgaccataggatataacttccataatcctcttataacctttattaaggagtcggttaatgctttaagaaaaccttgttaatctgacacagctgtacatatgctggtattgccttaatgtgcctttgacattaatgattgatttatagataaactgaactgattttatctttaaaaatggccctatagcattaggagaaatatcaaatgtagatgatgggttgatgagtgcagcaaatcaccatggcacgtgtatacctatgtaacaaaactgcatgttctgcatatgttccccagaacttaaagtataattttaaaaaaaggccctaacagtctcacatccccacctcctctgcgatagtttttgggccttgaggagttgaatagctttaatttctggccctgtatgtctcaggaatacagtttattttgactggcatcttttaccgggcctgaagataaggctgtaactgcttttagtgtttatgctttagcaggacttggtgtcctttttagactcaggatttaaaaccatgtaacttaatattacaaggactttaaaagcacatgaagaaggatacacatatgtaataaccttaattaaaaaaattaattttagttattttcctaagcaaaccaaaacttaataataatggcataggaattgtttcgataaactgtaaaatcttttaggccagttaccaaagggaaaagaaaaggccttttgcactgtacacaatattatgatggaagaaaatattttctttagagctttaagaaaatattgttagtctcaggcaataacaaacaggacatgaggaaaaaaaattatatgagctgaaaatgtgttgaaggagaagttttgctattttacacccttaaaaggggagagaaaacctaaaacggtgagatgcaatacaagttgaacattgtgttaaaaacaaattaaaatctcatataatttattgagtaaatcaatcccttaagaaaatttcattgttttaaccaattatgtagtgtatgagtgtttttgtatatatcaagcccagtctttaaaaagaccattacaatttccctttaattatagacaactttattatgtaaaagtttttatttttatttttttaataaattctcttcttgtgacttacccagactgttcatgacatgcttggactttctggtttgtcctgaacatcactttttcttaaacaaccagttattttattataggactaaatctaccctacaagattttttttcatattaaattatttttctttaagcttttttaccaaaaaaccctttttatttttacaacttcctttacatctttcttatttcctggttccttttaccttcttgtaatataacctttaaattagctttgaattagacaaaatttgttcaccttttcaaaaaggacacactttttttcaagaaagaatgtttttatacaaatatattattattggaaaatgcccaaataatgaaatatctattatttaatttaactttagattttaaattataacacttttgtttacaagtatttatcccattacatttacctaattattttctttttatcatttacctagattgtgtatgaaaactgaaatagtcattatttaaagttattgaactgccattgcaaaattgtacctgagacagtaaaaaagatttgatctaactgacttcatcttgattcttgttcattcctcggtattggctgaacaaactaaattaggaggaatttagtttatagtttagctttgaatcaaagatgaagataacattcccttcccaaaacaaaccgtattgcctgtggactagtccacctaaagccacagaattagaagttatggtaatcttactaaatttaagatgtatctatttttattaaactcatgttaatgtcttatttactaaagattatggaagcaaagattattttctcttgggctgggtttaaagtttatagccaaattttgacactgtatagtatttgaaaggaataagtatgaaattacttgaataataaatacaaagaatgtatgctggcaattcttaacacatttttaatattactttaccaataattttaaagctggcttatttattaaagattttacttaagttaaataaacttgaaaaagcatttgactagccttttcttttttcatgataaagtatttgatttaagcacttttattttcttaagccaattagagatcttttatatattttcagtagtgaaacattgtgtacacaacacaaaaatacatagatgtattaggcatgcctatagaagtacatctttagatttatagatttataaagacctttttttctatcttagacttttagattcttaataacatgttttataacccagagcagttttcagctaaatagccttaaatttgcatattaaaggagacaactcaggtgaaaatcaaattacaaaatttacataataaggtactgagacaaaaagtctggtggtgctagagggagattaaagatggatgccaaattaaacataaaattatagaaatctgtcatagaattgtataaggagaccaattttatttagatacagactacatatattttaactggatctttgagctctgggcagagcccacactgaatcctgggtctccaaaaagggagaataatcatgatcttagactagcatggcatccatgcttttacagtgcacttaaaataattctttttaaacaaagatatttctaagtgtttgaactgcatgcttccttaaaacccaaaagtagcctctgttgtaataggtattttagttaaaaaaatcaggttacaaaatacgaaagcaagcagtttatttaagagctgagacaaacttgtctgtatattcttttggtattccataaaaagcaaacaaacaaacaaaaaacagaagttcctccccaaaagggagctaggtaccttctttgatttctttaaggacccccaagatattttaaactattttaggtcccacatgtagtagatggtgcaagagaaaggagagagagtagatgtaaatggagaaaacagaattcagttaactgagaagaaaaaatattttgctcaaaaaaaggcaaggttctaggagagaaaaaaaaacatgaacgccttttaaatacaaacaggcacacaggcacacatacacacacacacgtcttggataatgacttttaattaagcttaaccactgagctcctttaaaaatttttttaaatctcattatcatatttcagctaggagaaattgctgctatttcagaagtaccaagtatcaaaccagaaagggctggattcaggaaccaaacccagggtgtcctggtggaagaaaaaaaaaaaaagaaggcagaaccttagctgttgaactccagcatgggtggacagccattgttctttcagtttggcctggctagtaaaaaggtggccttgttatgtaaataaagcccctttagtagttaaaattaaaaaaaaaattcatttctttttcccttttgctgtccattttctcccccactacaccacctttgtgtgcatgtgttgtggcagggtgtcaggggtggtggtggggaatttagccacttcagaggccttgttccccataatttggaattttccttcaaattttatcaagtctgatagagttggttaaacccaatgggaaaaagactgaaggaacaataaaaataggaacaaacatacaacaacaacaaaaacagttaaacaaacaaacgacagcaaacaaacacattatgtgattactgaatattgtaatggtaaggagaaattaagaccagctggttcttaaacttagccaagacaaaaccccaatttagctacttacctagggatgggtctcaggctgaagaccgtactctaccagcctagaagctggaaaaaaaactaaaaaacaaaaacctgaactcatcttccctgctgcaaatgagctcaaactccataaaggagttatctgcctttcatcatcatggaaacagaaaatcttgccttccttgttggaagcaagtaaaactccaaaaaagggaagttgtacggcaaaataaactttagatctcgaccaaattttgggagatcagggattctctggacggtatgctcccagacctcagcaaattgtcctattggagccataatgtttgcttatgctgatatcaagcaccaataggagatttgtgaaaggtcagaggcatctccagtcagaattgccttgtggttaccaaaatgtgaacccccaaaatctgagacaggtctcagttaatttagaaagtttatttgccaaggttgaggacatgtgcctgtgacacagcctcaggaagttttgatgacatgtgcccaaagtgattagaacacagtttagttttatacattttagggagacatgagacattaattaacatacataagatgaacattggttcagtctggaaagtcaggacagcttgaagcaaagatgggaagacttgaagcagggagggggcttccaggttataggtagataagagacaaatggttgcattcctttgagtttctgattaatttctccaaaggaggaaatcagatatgcatttatcttagtgagcagaggggcgactttgaatgaaatgggaagcaggttggctctaggcagttcccagcttcatttttccctttagcttagtgatttgggggcccccagatttattttcctttctcaagtgttacatctctagtagatactgcaattcaataagtaaaaatgctaggattttttgctagttactaggaatataataatcaaatgcgtgattgcaaatattataaagtcacatgaagaaaaaggacaggtaacctaataatgatagtacacactgtgactaattgttgttaggaaagtgtagtacttaagaactagagtcagaatgcactgattttcatttcagcttcactacttattgactgggtaaccttctaagccttgatttatcatctataaaatgaaattaataacattacctaattgatgaggtaattcggagtattaagtcagttaatgtacgaaaagtaattagcacagtgcctgggaaatagtaagcactttatgaatatcagctctttttagtagtagtattgtagaagtatatgtagagaaatcaggagtaaaatgaggattgccattcacacaaaatccagaactggtaggcaatgattctagaataagagttacccatgggtggaaggtataagggatgagggaaaagtttgtgccaaacagggttacagaggtttgctaatgtatgtcaagtttttgaaactgctggtataggcataccttgttgtattttacttcgcattattgcacttcagagatgttgtagtttttttactaattgaagttttgtggtaaccataggttaagcaagtctgttcgtgcaatttttccaatatcatgtactcactttgtgtctctgcaccacattttggttatttttaaaatatttttatttttaaaattattactatatagattatggcaatttgtgatcagtgctcctcgatgttacttttgtaattgttttggggtgccaaaaactgtacctatataaaacaagtcagcttaattaatgtggtgtttgttctgagtgctccattgactggaagttctgtctccatctccttaggcctccttttcattgagacacagcaatattgaaatcaagctgtttaataatgctacaattgcttcccagtgttcaaatgaaaagaattgttgcatgtcttgtcactttaaatcaaatgctacatgtgattaagcttagtgaggagggcatgttgaatgccaatacggccgaaatctaggcctcttgtccgaagaattagctgaattgtgaatgcaaaggaaaaattcttgaaggaaatgaatgctactttagtgaacacacaaatcataagaaaatgaaatagcctttttaatgatatggagaaagttttagttgtccgaatataagatcaaaaccactataacattcccgtaaacctaagcttaatttagagtagagcctaactttcttcaattctacaaagtctgagagaggtgaggaagatgcagaagaaaatttggaagccagaagaaggtggtttatgaggtttaagtaaggaagccatcttcataacaaaagtgcgaggtgaagcagtaagtgctgatatagaagatacatgtctaacttaattgatgcagtagctacactaaataacagattctcaatgtatatgaaacagctttctaaaagaagataccacctaggaattttatagcaaagaagacatgtaaatgcttgacatcaaaattcaaaagacaggatgactttcttgttaggagctaatgcatctggtgattatgagccttggtaatgagccagtgctcatttacccttctgaaaatcctacggtccttaagaattatgctaaacatgttctgcctatgttctataaatggaacaataaagccagcatgacagcatatctatttacagcatggtttactgaatattttaagcccactgttgaggcctactgcttagaaaaaaaagacttctttcaaaatagtacagctcattcacagtatacctagtcactcaagagctttgaaggtgatgtgtaaggagattaatgctgtttcatgcctgctaacacaataactgatacggtttgggtggtgtccccaccaaaatctcatgttcagttgtaatccccagtgttggaggtgggggcctggtgggaggtgattggatcatggggatggatccctcatgaatggtttagcaccatccccttcatgctgttctcttggtgctgatagtgagtgagttcttgagagatctggttgtttaaaattgtgtagtaccccctcttcactctctcattcctgctcctgtgcctgctccgccttcacctttcaccatgattctaagtttactgaggcttccccagaagccttgcagatgccagcatcatgtttcctgtacaacctgtgggtctatgagccaattaagccccttttctttataaattacctggtcttgggtatttctttatagtaatgcaagaatggtctaagtacaataaccatttggcagcctgtggatcaaggagtaattttgattttttgtactatttttattaaaatacattttgtaaggctatagctgacataggtgatgattcctctgatgaatctaggcaaagaaaaatctctggaaagaattcatcattctaattgcctttgataacattcatgattcatgggagtagatcaagatatcaacattaacttgagtttggaagaagttgattcccaccctcatagatgactttgaggggttctagatattagtggaagaagtaactgcacttgtggtagagatagcatgagtaatattgatagaattataagtggagtttggagatgtacggaattgctgcaatgtaatgataaaactttattaatgagatgttggtttttatggatgagtaaataaagtagtttctggagatggaaacttttcctggtgaagatgctgtgaacattgttgaaatgacaatgagttggaatatcacataaacttgataaagaagcagctggatttgaggattgactccaattgcaaaagttctgttagtaaatttttatgaaacagcattgcatgctgcagagaaatctttcctgaaaggtgcagtcagtcattgtggcaaatatcattgttgtcttattttaagaaattgccacaatcactccaaccctcaggaaccattaccctgatcaggcagcagctgtcaacactgaggcaagaccctccaccagcaaaaagaaaacatgctaaaggctcagatgatcattagcagtttttagccataaagtattttatatatattttcttctagacataatattattgcacatttaataggctacagcattgtgtaaatgttactgttatatgcactgggaaaccaaaaaaattttgtgacccactttattgcgatattaactttattgcagtagtctgtaactaaacttgcaacatctccaacatatgcctgtactgttatttgactgcagtgttaatgctattagcagagaaagaagcaaggctaagtttctaagattggtatatgatatgttaatgtgattggacgtcataaaagtgagggagaaacactgaggaaatttaagcaagggaattaagaagtgtttggaggagaatcacagaaacctcttttggggttaaagagagcactttgtcagttaagtttgtgtattaaaccatgaggaaagttatgagtgccttcattcattaggcatgtgtttgctatagaaagaacttaaactatttaatgtttataaacaatatccaaggatttatcatcagaataatatgctataatacttatgcagagctgtctggtatatttattcctcatgttttattccagaaatatgttttattttgtcttttacaattgtctattttctgtgtaaccatatttttaaaaatattaccttgtctgaattatatacattattattgtattaattatctgttgaaagtttatatggaatagatttcatcgtggatcttagtaacagctaatttaatctccaatttgaatttatttatattttttaaaagaacaagtaagaatataacctaataagatctcaagttgtttgcctgaaacagcccgattgtctttaagatatgactagttaactagcatcctttatgtaactatgcttttaaatccaaatagtggtttgcaagaccctctctttcccttcagttcgttagatgaacttgataattttagcacattcttttatattacattttccttttttgtttatctgaaatattatatcagagtttattatgtctggcaagctgacgttttgcacaaacacatcaatttatctttcataaaataagaaattttctcccacaaattttgacattttgtagtaaatatcaagctattaatctacttctctgtccaaatgcatttaatgcaacttttttataaaatcataaaatttaaaatattgatcattattattaattcattaaaaatatagcatatcttaaattcaagttttagattttggacatgttttcagtatgaatttacatttacatttgaattgacaaaatgtattatcagggttactgtagtttcagctaacttaatttttagcatgttgtcttatcaattattttgggggttttttaaacagatggggaagatgagaatatgaaattgtgtcactaatcagtctttattttgattattgtttgaataatcactgtataatgaataaaattattaccgaagacagaattacaaaggtgcatttatactggcttaagttttaaaactaactttaaatgtaacttgtgtaaacatgtcatatttttcatgggaataccacagaactaaatggaaaacgttatttgcaagagtcatgttctagccatggcatcaacaaataggaatcttcctaattagaacataatagattttacagtcataaatatcccataccctgagaagatatactttcatagaaaatacaaatttagaatattgttgccgttattgtctcactgttttttaaaagcagttggctaaataatcattcttttaagatggtatcatttttaatacattaagaaataatatttcatgtaatgccacctaattgagacacaataacatctgtaccttcttcctttcatagcttttaataaggatatttgaagtcctaagaatactcctgtgctaaatcttgctattgaatctatttattctataaatttcttgaagttatttatttatatttataaatatttctaaattacattcatttatttataataatttatttatttattcagtagttttattgagtgctttctatatactgtctaccaactactgttctagtcattggaagagtgctgtgaacaatatgaacaaggctactgttctcgaggagcttacattttagtggggaaaagacattttaactaatgatcaaccagtaaaataaaataattttagattgtagtttgaaaagcatagttttatacaatactatagagtaagggggtggtaaattactttacatgagtgtctttaagaagtgcaatatttacggtgagacctacatgatacagagcaagccatgtgaagaccagttgccctacatcacttaagaatgattctcctttgtgcttattccttttcctagaaaccaggcttgtccaacttgcagcccatgggccacatgcagcccaggacagctttgaatgcagtgcaacacaaatttgtaaactttcttaaaacattatgagatttttttgcgatttgtttttttgtttttagctcatcagctatcgttagtgtgttttacgtatggcctaagacaattctttttcttccactgtggcccagggaagccaaaagattgggcacccctgcagtttccagttttattagaaggggcctggaactgctgtatgctattgtagacagagaaaaactgagaatagccagatacacttgaacctaatgctgtgcttcatttctttctgctctctgtatcaaattttcctgtttgatctcagcacttctgcatatttttagatgttaaaaagcgatttcttgtcccacccacgtgagtagtagaagacaggatatttttcatgttcttttttctcatagcacttactgagttccaacatattatataatttattattatcgccatttattatctgctctcccactaagaattttttcactgctagcttttatttttaactgatacatccaagtacctggtacaatgcccagaatataatagatacttagtgatttatttgatatatgcataaatgtataccccttaaggagggaatcttgaaagagaatctgattgagttagtgtctgcttggcattgcttactaattttacaaaatcatccttgtatctgccttccatttccataattaattatatcttatttttaaagtatatacctgacaatggactgcaacagtattttccataggcaatttcctgtggaattttctatggaaagtctcgggtggaggaacattttgaaatatttgtacaacaaattgtagtgctgactcttctgttgaatagccagtatggaatatattcaacctgagcctgtagcctccagctgggactccaagtacaaaaactgcttgtgctgagtctacatttactcttgagtgccatttattttaacagatttgttactctgagtgtcccttgcatcagtttttaagaaagtctgtatttcagatggtactttttatagagactttacccatacacttcatcccaccattaatactcattattgtaaaaggtaggagagtattatctgtagcaggagttggttgaggtcttcaatcagtactttacttaatgttcaagtatcatgtgtaacctaatttgaactgcagctgttatttttgataattttaaaaacagtgttaattttgggaggtccaagtgtctcatcacccccaagaagtggtatttcagcttattctctgaaaacaagctggaatcaaaatagcattcatatttcttatgaaaacttttacatttgtctttattatgtttattaataggtaaagatagataatgtaattatttcaagttttagaatgttttggttctttacttcctgacttttacttgaagaagtagtcagtttcctctggctactttatttattcaaatattctttgggcagatgtaaaaaaaatatatagagatgtttcatgtgtgcctatgtcttgcttacttgcctgaaattatgatctttcttataaggtacttagttatatggacccacagatggcaggtaaaccataataaaattctgcagttccagcctgaatcatgtgcttcatcaatttaagtatattgttagtctgttggttactcccactacttatacaccatttaaattaaagaaatgccaaatcctttatatgttaaagaatggcagatatttgggagtgataatgagttaaatagggattgcacaaggggattagtgaagactcatatttgaatattatatattttaataatcaatgcttttttcccctaaaaatgtgccacttgctctttgaaaattttccatctcagttcctttccccacttttgttggaccttctttgttttgtctatatttattttattctgcttaatttcgattttcacttttagcagtttctcctcattatgagaccagtcctggaatagagatttgactggttgcttttgaaagttcatgtactccaactgttccaggcttctttagaacttcctcaggatcccttcaactaacctagtcttgtattgagcaactctacacttctgttttcacttccttattcaagttggcctggcctagttccagttaatacctttttgaaacttttgagttttcctattgattccctctttttcctgcctcatagacactggtaccttccacagcttgagtttgtcatttacccgtaccagtttatgttttgacatttaaggggatagatagtctgccacttacttttgttagaatagttgttctttttttttttttttttggcttttcaatttagctgctatatattttaatattggaagtcaaggatatcaaaaactatcctgctacgcccactgcccactcagaactctgtcccttggattgcatttgttaatttctaagtagttaagcttgttttggccatatgtgaaattatagttttaattttattttattggaatatgttaatgtaccttataaaagctaccatttagatttttaaaatactttctctgtacaatgtttattgtcttctttttaaaatgttctatggattaaaaatatattttaaatcatctgtgttcttgatgatttctgctctgttttgtaacataacttcttgaaagttcagcctgtagtttgtttctactttgtaatgttccacattctccttatattattctgtttatattaacatccccaccactctgttggaagttcatttgtttaaattactcatgaagttcatgttgtcaaatccagtagccatattttcatcctcgtcttaaccaacaaaatcaaccactactttcttcttgcaacatttctgttctttgatcatcttggcacaaccctttcctggtttcctcccacctacctttccacttcttttttttaagctctaatgatggggtggccctgaatatcctcttagagataatttctcctgcatctattctgtctcctagggactatcaaacaagtacatgatttaagatgacatttatgttcctttgatttccaaatttttaaatctaacctttcctgtgagcttcaagctagtagttactgtctactcttgaacatttaataggtatttcacatttaacatattctaagtaagtttttctttccttatttctcccttgatcctcatggcacttttctattctcaataagtagaaatatcatctttccacttgttcttgtgagagcaaactacaatagtcatgactgattcttctccttcattcacctgtcatatctaatctttcttcattcacctgtcaaatctaatccttcagcacgtctcctcacttctctctctaaattatgtacctaactacttatttttgtcttgatgactactacccttgtgcaagctactattgccttatgactagaaaaatcaaatatcctcttctcttatcttctggatttccccaattatttctttctcacccaacagccagaatgatatttttcttgagagttagatcatgtcattcccatagctcaaaactttccatgggttcccattgcccttataatatattccgaactctttgtcatggccaacgacctatgtgacttgctttttgctttctaatctgaatttatttacaactactctgtcctttgctcacaatactccagatcttatgacttttcataaacatgtctaacctaatcatcatctttacacttgagaaacctctaccaacagatatttgtgtgtttttaaacttcttatttggatataagctcatatatcacccctttagtgaggccagcagctctaaccaccggatccaaattagccgcaaatcctcctagctcatatcatctttgtttttttccactcaaaacaccactgtcaacaattgtgatatccccctacaagttcacctggttattttctccctcctgctattagaacataaaagccaaaataataggagctttgtcttattacaatggtgtagaacagagcttgtttagtgactatttcttgaatatttttacatgatttaaatgatttaagtagatcaattttgtgtctctttgatcagataacttttaaaagagatatgcatgttaataatttcttccaaaattttgccattatcaaattccccttatatgtccagagattgtgtttttacttacttggcctgtatttttggtgcatattgttttattattgttatgttttctttgtctcagtgttttatttgatcaggttttgcctttgaatttcactttgctattaatattggtttatatgttttattgtttttaagtgcctattatatcttcttacagtattttatattttagataaaaatgtgtcactgttctatatgtgttttctgctaaaaacgtaaagctgaattgtatctttactgcaaaaatctctgtctttcaatgtggattcaccctgttgacatttactgcaattgcactgtatcttattcagttaattttatgttatgtttattattttatttgttatttcatctgttctctttttttatatatttgctaatttattcaagcctttgttcaaggtccttatgcccccttttcatttaggtatttatcaacattgcgtaaggtttcctcctattccaatttgtcttaaataaactaattttctttattatgatttcaaaatattatcattttgaagatttttcctgttcttaattattgtttccagaattctgttaccatggatttaagttcttgttgacaatattctttgataagcttcctttctatgatattctatggacaaagacctgggaagaaaattcattcttttaaactttaaaagatgttttttctttaatcttttataatattttcacctataaccaatctcctatgccaattatctttcttcagcctttgtataagtgtttcataattcaatagcttagaagcttgtaggaaatgaatattactatatttaagcttacatgtacatgccaaagaatcattttctcaacttactgtaattctttacataagaaatactgacatcccttattttagaatgccatttaaattccttagtgttctttccttgcactggaagctgggacaattataggattaatttcctttgtttttcttcactcagggatcataatctctggccagttgtccaatgcctgaaattggttgtttcagatacttcacctagttttccagttgtttacagcaggagggaaaactcattccttttagtccattttcagtagaaattctattatgtttttgcaacattttcataaaatattattaaaagaaaaagagattttaatacctgaatggtttagcttcagcaatgtgggaaaactcacttatattgacatctcatttatacatgatacaaaagtttaataatgtttatattgtaacttttacatgccagaaattatggtaaacattaaatttctattcagttagattttctataacattataaggtagatgcttttattattaccattcgcatatgggaaaactgagaaatagactagtttttcaaaatatacagggctagtaattgaaaaaccacattacacaatcagttattctctatccagatgctatattgttgattgatatactataatacacttcctcaggacagatgttacagtatgatctctataatgttaacagaaatggagaacgacttcaactttttggctagtttcaccttttaaaattaacttcttattaacattaacaagttttaaaatgatgtgacatattttattatttgaatggtgtgtaacaaaacatttgtatatatatatgaagcttccccagatgaagttatatagggagaaaattccctgttttcttagctgagttgaaatgtgggtgttttggttaggcatatttaatctgtcatagtatttcacatgaaactcttagcgtgcatccttaaagtaattatataatagtttttaaaatatttaatgtcgtattctacactatgaccatcattagcagttggatatattaggtattctagatgaaattttcattccatcacatatttgatttataatatcatgatccaaatgtcttggtgatttagaaaaactgtatttacaaatgtcatgaaatatcaccacaggttttagagaagaacatactttcaattttttttattttgatttttcagattgcattctcacaacacaatacaatcatggaccttgtgcagttttttgtcaccttcttcaggtaaaagtttgctttgactgactttgaacttttcaagcctgtattctgatatatgtcctgtcaatctgttagataatcgaccaattctaaaaccttaaagtatcatagagtatgtcttgaatagctttatatgcttaaatatatcccacagaggagaggtaacatagctgaaatgtacttgtgcaagattattttgctgttatactatttaatagccaatggattcagtggaaagaggataactttgtgtcccccatcacataaataattatagcctgttttaattaatgaaattaacaatgcatgcaccacatggattagttacatctacaagaactaaaccaatttgtttatttcttagttaattttgttaattgtgtgacatattcgttgtaggttcataaaaagggctccacagtgaagcagctttgtaaaatgctacatgtcctaaagttaaatagtgctcttttggttggttttcaactggcattacttctcaaagcttttaaaatgctaatttgcaatatgtcattctacaagagaggttatagtttgtagcatttctcaaaacatgaaaactgttttcagggaacatttattttcatttccatgggatgtaaatgtagagactctgggttaggagtttaagttataaaatatctgtgttatgagatcgtagatcctctggattggaagagatcttatttttgttaacattattattcacgtgtgaagtttatgctggtcatttgggtgcctttgtacaaattagacaaatatgacttctccttctggcagatacagccccacatcatggcacacaaatttggaaatagtgcagtatgaattttaaccaacactcaccaacttggctgggctgccatacagtaaagacctgcacaactcaatccttagcacagatgatgtatttggaacttgtctaaacacaaagtaaccatcatctttttgattgtcttgtccagatatccataaagtatttgaatttctaataccttcttcactggagtcagcaaacattttccattaagggccagatagtaaatatttcaagatttgtgggctgtatggtcttcatcgcatctatgcaacttttctgctatagtgttaaagcagacaaagccaatatggaaacaaatgggagtggctgtgttccaataaaactttattataaaaacagctggtggattgaattcagcctgtggacataatttgcccaaccactgatcagttttatgcctgaatgcctttaatgacaggaagctcactagctcctcagatggcattttctatcatcagataacaaattgttctttataactgagctgaaatctgcctccctatgatatctctcctaattcctccatgtgggcccatatataacaatttcaatttctcatttccatttacagcccttcagatttgtaaagtattttctacggtttacacattccttgttcatttttctacttctcttgataagagaaacctttgccatattggtcagtttactctgaaaacaatcatgttcatccatgcaccttaaaatattataatttctataatgtatttctataaacatatttatcactaatatgtgtaaaaagtgcattcgtactttaaattgttccttaaaatgaaatttgaggaaacatcttaaatatgtttaatattttacaactttgtacttcagaaaacaaatgaattttaaggctattaacaaagttacagtatggttttagaaagtactagaaattacagttgaacaagcattattgaatgcattaaaacaacttttgttgttgttgttgttgttgttgttgttgttgttgagacagggtctcaccctgtcacccaggctggagcagtggcgctatttcggctcactgcaaccttcacctcccgggttcaagcatttctcctgcctcagctcctgagtagctgggattacaggcacgtgccaccacgcccagctaatttttgtatttttagtagatacggggtttcaccacattggccagggtggtctcgatctcctgacctcagatgatctgcccacctcggcctcccaaagtgctgggattacaagtgtgagccaccatgcctggtctaaaaaaaactttttgatgcagaatagtctggaagaaaattcactgaaagtttggttaagtgaaaaatttcacaaagttgaatatgtatgtaaattatttgaatcttgaggttttttattttaagcttttgaatttgtgtgcatatttaaattcaatagctcttttgttaagtaaaagaaaattactgttaatgtgtaccatgtcttagagatgatcctatttattatgttgtcatcatggacaatgtaaaataaaatattctaatctttgggtgtgataaaatatatttgatgggttttttgtcatttaaattcttccagtagtgaaatgtaaattagatcacttaaaaaactgggtcattgttaagaaaaatatggacaggatattttgaagcttatcaattattaagttttataaagctactgctaaactttaggagattttaaaacaggttaacatttatggagacccctcaatcaggccatttttactgttattgctgttattttggtaacagagctgagtgcgtcagctttgcagtttagccattgttctgtaggggctggttctcaaactctttgttagattttacctctatattgtgtgtagttctgatggtaaacataattgggccagtactagggagatcacttacagacataccctggctctgttcttaatgttttatgccatcttaagtaggtcactattttagtttgtttgtattgctgaaaaggaatacctaaggctgggtaatttataaaaagaggtttatttggctcacagttgtgctggctgtacaagaagtagggtgccagcatgtgcatctggtgagggtatcaaactgcttccactcatggcagaagaggaagcggagctggcatgtgtagcaatcacatggggagagaagaggtgacagccagagactcctttaaacagccagctctcttgggaactaatagagtgagaactcatttgctaccataaggacaccaccaagtcattcacagggagtctgcccctgcaactcaaacacctttcattaggctcaatctccaacgatgggtatcaaatttcaatatgtgctttggagggtcaaatattaaaactatagcattctatccctggcccctcaaatccctggtgttcttctcacatacaaaatataatcatttaatcccaatacttcccagaagtcttaacttgtttcagcatcaactcagaagtccagagtccaaagtctcatctgagactcaaagcaagttcctttcagctttgagcctgtaaaatcaaaatcaaattatttatctccaagatacaatggtggaacaaatattgagtaaacatctcattccaaaagggagaaactggtcaaaatatagtgataacatgctgcatgaaaatccaaaatatagcggggaagacattaaatcttaaagctccaaaattatctcccttggttccatgtcctgcaccctgggaacatggatgcaccatagccctgctctactaggcaatccctggtgggtactctcttcagggcctccaaccgcatatttctgctcagcattgcctcactagcatctgtctgcagggtctccacccctatggcaggcttctgcctgggcactcaggcttttcaatacatcccctgaaatctcagtggaagccgacaagcctctagtactcatactttctagcctccttcagtggcagtaggcacaatacctggggccatttgagcagcgagatgtggggagcactttctagagatggggcatggcaatgttgtcccaagcctgtcatccaaaaccataccatcttccttgggctcttggtctgtgatgggaagcccagaagcctgccagatttgtgaaatgccttcagggtctttcccccattgtctttactaatagtacctggctccttttattcatgctactttctttaacaagtgtttgctaccccagcactcttctgaaaacactctttccttctctgccacatggccaggctgaggattctacaaattgttatcccctgctttccttttgattatacattccaactctaggttatttatttgctcctgcatgtgaacataagctgttaaaagcagccacattacttcttgagcactttgctgcttgtcatggacacaatgtagcaaagttctttgacagggcataacaaaggttatctttgcttcagttccagtgatttcctcatttcagtctgagaccctcaacatggcctttactgtctatatttcaatcagcattttggtcacagccacttaaccaatttctaagatgttccaaactttccctcatttttctatcttatgagcactccagttctaaagccacttttacatttttaggtgtctttatagcaacataccacttcctggcaccaattttctgtcttagtccatttgcattgctgtaaaagaatacctgaggctgagtaatacataaaggaaagaggtttacttggctcatggttctgcaggttgtgcaagaagtatggtgttggcatttgcatctggtgagggcctcaagctgtttccattcatggtggaagaggaaggggagctggtatgtgtagagatcgagatcacatggtgagaaagtaggcaagagagaagacagaagttccagactcttttaaataaccagctgtcatgggaacatgagacacaacgatggcacaaatccatttatgatggatctacccctgtgacccaaacacctcccattaagccccacctctaacattgagtatcaaattttaacatttgatttggaggatcaaatatccaaactatagcagtcacctagcttctctaaatctcagtcctttcatatattgaactaaaggtttttttttcttgttgttgctgtgaaataatatagtaaataattcaaaaattgaaaagaataattttttaaataaactcttcttgtgtgtaaaatggaaaagtagatgtatctgagtcagaaaagtctgaattatttattttaaagaactaaattaaatggaaatttggtagagactactatccctgtgttagacttttagtggtggcattaattttctatatcattggatgacattatattttgtatttattaacttgtccagttgggagtagtttcagagattaccagttggtcttttccactatgactgatcttatcctataagccagggacacagtgtagaggttattccagctaccttgtacatcagttctatttatacacttaaagagtggggaaatgaccaatgggtggatccattgacatagtgggcacactgtgagcaagaatttagtcagaatttgttatgtgcccccaccccatgaacaccccaactctaataagaggacatgatgatattttgaatgcttggctatctgtgtctaatgggagtcaattaggccctcatgtctaatggtagtcaaaatgtctgcttattcctcctgtactgtatatatatcctcatgcatataccaatgtatataatcaagtttatggtgtaggtattttcagggatcattttacccacttttcaaaatgtttcagggaccttccttctatggactcagtcacctgattagttaatcggttttggattttaaaattagctgaaatctgggaactgtgaagagaaacatggccctccattgaagcaacaaccctcagtctcctgttccttcattcttacttaaaatgaaaccagatgttaaatagtaccactgttggctgcccacctattttcccttcagaataccatgccttattaataatccctacaactctttgtgagccaacccccttggcagttcgtccaatcttgttgatctaattatggtaattgtggtttctggattctggcagttaagcgctgacacctgtcgtctattacattgggtctccatctttttatggcaattaacaaacctagccctgtgactatctctcgtattttcgggactgctctgaagaggagagccagctctaagcctccttataatactggtgcctctcttatcagcatattcataacagccttaatgcatagtttgtcctctgagtcctcccatggaacacaacctggtagttcttctggcctcctataatataaaccattccagcatatccccttctctcagtgtttttataactttctcttccataagccaggacaacccaggcatttcaatttcacttgtactggacattgcatttttcaggcttctacgagtcactctagcaacaagtttgctccattccctggaatcctcagtagggtattacatctctgtggtcctgaaaatatgcaccaaaaccaatgagtttttatttatccagtcttaacatttcgttgccctttatcaaatatttaaatctggtcatacttccatggctcctgccagtacgtgctccctaaatcttgcatccgtatcaattgtgtaatccattttctttcgtatcaggctcagttgggtcatgctgtgatttaatccccctaatcagtctggcagccaagaaaagaagtggtgacagtttgtgagggggcacctgttacctaagagagaagagagctctttagtgtcttccagcataacgaaatgctaggtattgctagggaagcggttggtaaaaccaacatcctcagaagcattcattcatatattcctattccatatttcaggttcctaggtctcctgaaccatggccctttttgcataacacaacttctttggcttagcattctgtcatctctggagctctgcaactctacaacaattagatcatcatcctgctggtcattcatgttggcatttctgctatcagtcatcagggcctcatttaaagctatgaaagagacccactggctcttttatttagccagtaaatggtttgttaatggccttcagtctctcattatccctctgcaggtatcaatacaacataatgataatcattctactccactctcttttgaaggtgttttccccatcttccaagcacctgaattgctgtaccttcaagtattttctctatcagtgcattttctcaggtcaccactggtgaaatccagcaatttaagtcttctgccaggaactgtgttccacccaccaacatggatgttgtcctcttagcctgccaatcagtgagtgaatcagttcctcatctccatcttaccttctgtttacttggaccataagtcctctgagacacagaagccaagatgggattagataagcaataaacgtgttaggggaacttctgtgaggggaaattgggagaagggaggggagataatgggagaatttgagaccacaatgcctacctgcctttgtgagggagagaagcaagaaagggaaggtgagtgaaagagcctgagaatgcagggcacttctaagaatgtttaacaccagtggtgtagccttgagcaaaagttacccatcaaaggagtcttccatctcccaggaacaggcccgccttggtatttctgccatgtttagtccttgactaaggacagcccttgggaagcatgggctcagtgtgaataaaatgatggatttcagagtgcagtagctggggccactagtcagttatgctctctgccatcagggatcagagaggcacttttttttttttttcccccccgagatagggtctcactctgcctcccaggctggagtgtagtggcacaatctcagttcactcaacctctgcctcccaggctcaagcgatcctcccacctcagcctcctgagtagctgggaccacaggagcttgccatcacagctgactaagttttttgtatttttggtagagatggggtttcaccgtgttgcccaggctggtctcaggctcctgagctcaagtgatccgctcacctcggccttccaaagtgctgagattacaggcatgagccactgtccccagccagagaagtatatcttagtggttggcacaatggagttatttgttgtgtgatggttgatagaactgacctataaaacctgtaaaaaatgattttggtaatgtgtttgtatttatttttgtgtagtttatatttttgagggtagatttttaaatttgactaagtttcagtaatatttgtgtctatggaggtttttaattttttcctgacctagttggtaattggctttttaatggaagttgtactctttgtttcattttataaattcattgacatatttacaatattaatactctgaagtttgttctatattagaattgtgcctacccttttattgagaattttgcctatttttccttccttccctccctccctccctccttccctccctcccttccttccttccttcctcccttcctccctccctccttccttatccttccttccttctttccttccctccctccctccttccctcccttccttccttccttccttcctcccttcctccctccttccttctccttccttccttctttccttccctccctccctccttccctccctccctccctccctcccttccttccttccttccttccttccttccctccttcctttcttccttccttccttccttccttccttccttcctttcccttctcatttctaaaaataatctgcttcagctgcattctgtagacattaatatgtagtatgctggtctcatagaatgatttaggaattgttccttccttttcactttttgggaaaagtttgagcattggtattagttattttttaaatgggtagaatttatcagtgaagccattgagttcagggcttctttgttgtggtatatttgattactgattcaatctccttactggttataaatctattccattttctattcctttatcattcaatcttggtaggttttatgtttctagggatttgtccatttcacctagcttatccaatttattagtgtataattgttcatagtactctcctataatcatttttatttctgcagaattggcagtaatgacccgacttttcatttctaaattttgtaatttcagttttctttctcttttctttttttttggtcagtctaactaaaggtttgccaattttgttgctctttttcaagaatcaacttttggtattgttgattttctctattgtttttctattttctctattgtttatcttgctctaatatttataatttccttcattctgctacctttgaatttagtttgttctttttctagttcaagttgtaaagttaagttgcgtatttgagatctttcttcttttttagtatgtttataactaaatttcccttttatccactgctttacagtgttccatgagttttggtatgttgtgttttaattttcacatttctctaaatattttctaatttcattgtgattttgtctttcaaccattgatcaaatgtgtgttggtaatttccacatactttttaatgttcaagtttttcttctgtttttgatttctaactttatcccactgtgggtggtgaagatactttgcacatttatcttttaaaatctaccgagatataatttgttacctaacatatattctgtcctggagaatgtcttctgtgcccatcaggagaatatgtattctgttgtttttaggtagaatatcctgtatatatctattagatcttggtggtttattgcattgctctagacctctgtttcctttattatcttctgtctgattgttctatcctttactgagaatggagttgaattattgttttaatcatttggatttctctctgttcctattgttactttttgtcttaaagaacatttttaacttaaatatagtatttctttattagaatttgtctatgtctttttgcatatcttttaaaattttttctcttgttatattttgtgtatgtttcttttataccaaaaatatctggatattttggttttgttttaataatctgggaatctcttaattttatgtgacagggaaataaatggaaattttcttttttcttctcttctgatttttattaattgaatgagcttcttattaattgaatgagcttctaatgttcttttattttccttttagcagtttaagaattatagttttttttatttaatgattactcttaaattttaacaagcatatttccctaaccaacaataatattaatcagtatgtcttttatcctcctgaatcatataggagaactaaaaaacttcaaaacttttacttatcattgtctaatttttaaacgttttccaatttctaattttaatttgtgttttatttggtgatataattcacatataatacaattcaccaattgaaagtgcacagttattcttcaaccattattgcaatcaattttagaacatatcatcatccccaaaagaagccatgtactcatcagtagtcactccccccttttacatacccctagttctgaaaaatcactaatctactttctgtccatagatttgcctattctggacatcttatataaatggaatcgtacaatatgtgttcttttgtgactggttcctttcattagcacaatgtttcttatccgtaacgtagtatggatcagtactttgtttctttttattgctgaataatatttcatcttatgtgtataacacattttatttctctattagttgatggttatttgagttctttcttctttttcactgttgtgaataatactactatgcacatttgtgtgtaagtttttatgtggatatatattttcatttctcttaagtatataattaggagtagaattgttgatcacatggtaactctaggttaaacattgtgataaactgccaaacatttttttaaagaagatgtatcattttataatcttaccagcaaggatcagacatttattttttccacattcttactaaagtttgtattaactgcctttcttatagccatcttagtgggcataaagtggtaagagatgatgcatatttagaggaattaaaaatgaaagattaaaggaatctaaagaatacaacaggcaaagaaataataagagttaagcgcttgaaaaacaagaacaatcaaagatgactacatggaagcaagcatgcaagtgagcagaataatgcaaagttaagtatagtgttcatgatttgggaaaaataagactttttattattattattatactttaagttttagggtacacgtgcacaatgtgcaggttagttacatatgtatacatgtgccatgctggtgtgctgcacccattaactcgtcatttagcattaggtatatctcctcatgctatccctcccccctccccccaccccacaacagtccccagagtgtgatgttccccttcctgtgtccatgtgttctcattgttcaattcccacctatgagtgagaacatgtggtgtttggttttttgtccttgcgatagtttactgagaatgatgatttccaatttcatccatgtccctacaaagggcatgaactcatcatttttatggctgcatagtattccatggtgtatatgtgccacattttcttaatccagtctgtcattattggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgagtaatcgccacactgacttccacaatggttgaactagtttacagtcccaccaacagtgtaaaagtgttcctatttctccacatcctctccagcacccgttgtttcctgactttttaatggttgccattctgactggtgtgagatggtatctcattgtggttttgatttgcatttctctgatggccagtgatggtgagcattttttcatgtgttttttggctgcataaatgtcttcttttgagaagtgtctgttcataccctttggccactttttgatggggttgtttgtttttttcttgtaaatttgtttgagttcattgtagattctggatattagtcctttgtcagatgagtaggttgtgaaaattttctcccattttgtaggctgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctaggttttcttctagggtttttatggttttaggtctaacgtttaagtctttaatccatcttgaattaatttttgtataaggtgtaaggaagggatccagtttcagcattctacgtatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattcacttggcgatgcgggctcttttttggttccatatgaattttaaagtagttttttccaattctgtgaagaaagtcattggtagcttgatggggatgtcattgaatctataacttaccttgggcagtatggccattttcatgatattgattcttcctacccatgagcatggaatgttcttccatttctttgtgtcctcttttatttcatcgagtgctggtttgtagttctccttgaagaggtccttcacatcccttgtaagttggattcctaggtattttattctctttgaagtaattgtgaatgggagttcactcatgatttggctctctatctgttattagtgtataagaatgcttgtgatttttgtacattgattttgtatcctgagactttgctgaagttgcttatcagtttaaggagattttgggctgagacagtggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaatcttttctgcatctattgatataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaaggatattggtctaaaattctcttttttggttgtgtctctgcccggctttggtatcaggatgatgctggcctcataatgagttagggaggattccctctttttctattgattggaatagtttcagaaggaatggtaccagttcctccttgtacctctggtagaattcggctgtgaatccatctggtcctggactctttttggttggtaagctattgattattgccacagtttcagatggtgttattggtctattcagagattcaacttcttcttggtttagtcttgggagagtgtatgtatcgaggaatttatccatttcttctagattttctagtttatttgcgtagaggtgtttgtagtattctctgatggtagtttgtatttctgtgggatcagtggtgatatctcctttatcattttttattgtgtctatttgattcttctctctttttttctttattagtcttgctagctgtctatcaattttgttgatcctttcaaaaaaccagctcctggattcattaattttttgaagggtttttttgtgtctctatttccttcagttctgctttgattttagttatttcttgccttctgctaggttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaaaaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctcttcttttacatttgctgaggagagctttacttccaagtatgtggtcaattttggaataggtgtggtgtggtgctgaaaaaaatgtatattctgtggatttgggatggagagttctgtagatgtctattaggtctgcttggtgcagagctgagttcaattcctgggtatccttgttgactttctgtctcgttgatctgtctaatgttgacagtggggtgttaaagtctcccattattattgtgtgggagtctaagtctccttgcaggtcactcaggacttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgcctttttttgttttccatttgcttggcagatcttcctccatcctttcattttgagcttatgtgtgtccctgcacatgagatgggtttcctgaatacagcacaactgtatgggtcttgactctttatccagtttgccagtctgtgtcttttaattggagcatttagtccatttacatttaaacttaatattgttatgtgtgaatttgatcctgtcattatggtgttagctggttattttgctggttagttgatgcagtttcttcctagtctcgatggtctttacattttggcatgattttgtagcagctggtaccggttgttcctttccatgtttagtgcttccttcaggagctcttttagggcaggcctggtggtgacaaaatctctcagcatttgcttgtctgtaaagtattttatttcttcttcacttatgaagcttagtttggctggatatgaaattctgggttgaaaattcttttctttaagaatgttgtcctattggcccccactctattctggcttgtagagtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggctccattctccccgtcactttcaggtacaccgatcagacgtagatgtggtcttttcacataatcccatatttcttggaggctttgttcgtttctttttattcttttttctctaaacttcccttctcgcttcatttcattcatttcatcttccatcactgataccctttcttccagttgatcgcatcggctcctgaggcttctgcattcttcacgtagttctcaagccttggttttcagctccatcagctcctttaagcacttctctgtattggttattctagttatacattagtctaaatttttttcaaagttttcaacttctttgcctttggtttgaatatcctcctgtagctcggagcagtttgattgtctgaagccttcttctctcaactcatcagagtcattctccgtccagctttgttccgttgctggtgaggaactgcgttcgtttggaggaggggaggtgctctggtttttagagtttccagtttttctgctctgttttttccccatctttgtggttttatctacttttggtctatgatgatggtgatgtacagatgggttttcggtgtggatgtcctttctgtttgttagttttccttctagcagataggaccgtcagctgcaggtctgttggagtttgctagaggtccactccagaccctgtttgcctgggtatcagcagcggtgtctgcagaacagcagattttcgtgaaccacgaatgctgctgtctgatcgttcctctggaagttttgtctcagaggattacctggctgtgtgacgtgtcagtctgcccctactggggggagcctcccagttaggcttctcgggggtcaggggtcagggacccacttgaggaggcagtctgcccgttctcagatctccagctgcgtgctgggagaaccactgctctcttcgaagctgtcagacagggacatttaattctgcagaggttactgctgtgtttttgtttgtctgtgccctgcccccagaggtggagcctacagagacaggcagacctccttgagctgtggtgggctccacccagttcaagcttcccagattctttgtttacctaagcaagcctgggcaatggcgggcgcccctcccccagcctcgctgttgcctagcagtttgatctcagattgctgtgctagcaatcagtgagactccgtgggcgtaggaccctccgagccaggtgtgggatataatctcctggtgcgccattttttaagcccgtcggaaatgcgcagtattggggtgggcttgacctgattttccaggtgccgtctgtcacccctttctttgactaggtaagggaatttcctgacgccttgtgcttcccaagtgaggcaatgcctcgccctgcttcggctctcgcacggtgcgctgcacccactgtcctgcgcccactgtctggcactccctagtgagatgaacccggtacctcagatggaaatgcagaaatcacccgtcttctgcgtcgctcatgctgggagctgcagaccggagctgttcctattcagccatcttggctcctcccaaaaataagacatttaatcatgttgtacataaacatattttgaaagagaaaaaagaagaaaatgtaactccctgaagaaaaaaggtgaacctaatttagtcacaggatctctacatcaaagagatataatcctagaatatttgccaaaaagttttttaaacaatgtgtaaggacactgtgaagaattacaaatacaaaaaagtctctgtttaaaaaaataagattatgatgatggatatggtaatggaaatgacacctgaagatatggattttgctaagtagaaacaataaatgatttcttactgtactggaagttcacttaggaattttctccatggtttttttgtggaatacagtagatacttaggacctaactgttcttgtaaaccaaaatatttaatgcggtgggagtaaactagtgatggtacgttttcttgcaacttagttaaaccagtgctccccatctagtttacaaagctgaggtttatcgtactagacactgaaatagacttctccaagagtcatatcagtaacttcacactttgacttaaatattgctttacacctcaaacttaacatgctttaaattgaatttactgtactgggaaacagtctctttttttccagttttctgtagctcagttataggtatcactatttaactcacttgaatacttgggactcatttaaatcctctttccttaatgacctacatgaacatcagttctaacttctttgtatcaatatattatatgtaaattagccaaagtggtaatttaaacataaattattaactccactgtttaaaatcttccttttacatttataattcaaagtatgagtattctcatacttaaagtataccagtcactttttcattgttagagggggcagtggttaattacttgcctttttttccagcatttttttggtccttattgtttgttttttacttctgttggaagcattttaaaatttctgtgcagtaaaattccttttgcggggagtacagttgtgtgagttttaacacatgcatcatttattataattaccagctctcccaggatacagaacaatgccaaagccccagtgaatacctcatagagccttctttgcagtcagactttctccccacccctacacgctggcaaccattgacctgatctctgttcttgcagttttgccttttccagaatgtcattcaaatggcttctttcccttagtctactgcatttaagattcatccaaggtgcttttttgtatcaatagtccatttcatttcattgctaagtagtatttcattatatggatatatcacactttgtttatccattcacccattgagagatatggattgttacagtttttggtacttataaataatgctgctgtgatcaacatacatacaagttttacacaaacataagttttcatttctctagcataaataccaggaagtagggttgctgggtcacagggtggatgtatattcatctttataatagctgccactgtttttcagagtgactgtacaattctgtgctgcgaccagcaaagctcagggttccagttgttgcacattctcaccagtgcttggtcctgtcaacattttttattttagccattctgataaatgtgtagtggtatcttgtggtaattttaacttgcatttccttaatggctaatgacgttgaatatcttttcatgtgcttattagttatactttcattttctttggtgaagtatttttcaaatcttttgcctagttttaattgctttttagttttgctgtttatttttgaatattgaatgttttttgtatattctggatacaactcttttgccagatgtgatttgcaaatattttccctcagtctttgaattgtcttttcattctcttaacagtatcttttatggagtgaaaagttttagtttttataaaattcaatttaatgcatttttttaaaaacttgattatgcttttgacgtcatatccaaggactctccctaactcaagttaacatagatttctttctaacagttttatacagtcaatgcactacataacattttggtctatgacagaccacatatatgatggtacttataagattatattactatatgtttactgtaccttttctatgtttagatacacaaaaaccattgtgttataattacctacagtattcaatacagtaacatgctatataggtttgtaccctagtaacaataggctataccaatggctttcatgtgtagtagggtataccatcagtgtttgtttaagcaccctctatgatgtttgcacagggatgaaatttgtctaatgatgcatttcttagaacatatccccattagtaagtgacacatgactgtatttttacattgtacctttagatctgtgatccatttcagttattttttgtttatgttgaggtgtaattcaatgctgattatttcacatgtggatatcctgttgttacaccatgatttgttataaaggaaaaacctttccattttgaaatgcttttgcaactttgtcaaacattcaccatagggttccagttccaggtaagattgtgtaaacacacatctctttttctctaagtgaactcaaccatgaaacctggacaaaattcatgggcagctatttggtatatgatatcagcaggcagagcagagaagaacaccagaattcaaagtactggtgaaccatctagaagtttgccatttttcccctttagtgccccctgacctgaagtcaatgcaatttgaaacttggaagtaactactatagtttggacagggtaaagtcctctagttctggcccatgatgtggaaaagggaactcttaagctcagagagaatgagggagacctccctcccattttttctctttttcctgaattcactcacccataccccaggcagtctgaagcaggaacatgggcagcagcaaaatggctcacagtgggaagcagtaagaaccacaatcccaagggaagggaatattcctctaatcatagtggagctctggctacagagagccaagataaaccctgttgatttccttcttgtctgtcctcccagctcaaaacatggtacaataggaaaagtgtgtagtttctgaccacatgatggaaaagtagagcccacaaatccagaaaggacctaggagataatggagatagaaaagccttcccatcaaatgttatggggtggggggagggggagggctagcattaggagatatgcctaatgtaaatgatgagttaatgagtgcagcacaccaacatggcacacgtatacatatgtaacaaacctgcacattgtgcacatttaccctagaacttaaagtataataataataaataaataaataaataaatatatagtgctttataaacttctgggatctctcctgagctgcctgtgtgctgatctgatcctaattaacattatcatacgaaagaattggagaactgagctcatagatagaactctgctttgggcccggactgaacagtgggtagccctcccgctgcactgactcaagaagcacttcaaaagctttggatgcattgtgaccatagcctccagatggataaaacaaattatctctctagagaatatcaacattatttataaataatacctcaatccctttgtaaagtcaaggtagcacaagagagatggattaaagggtacagtggaggccgggcatggtggctcacacctgtaatcccagcactttgggaggctgaggcaggtggatcacgaggtcaggagttcgagaccagcctggccaagatagtgaaaccccatctctactaaaaatacaaaaattagtcaggagtggtagcacacgcctataatcctagctacttgggaggctgaggcagaattgcttgaacccaggaggcggaggttgcagtgaactaagatcatgccattgcactccagcctgggcaacaagagcaaaactccgtctaaaaaaaaaaaaaaaaggggggagggaacagggctctaatggaagtagtcattcttaagttaattaccaagtcaaggactatctctcaatgtttagtgctttaagaaaactttcatcaggtactagatctattacctatgcgtatgggaaaggtgacatttgatccctgctttgaatataaaataaattctaggaggaaaggtaaaaacaatgaaatatctagaaggtaatgtaggaattattcttcataacattagaatatagaatggattcttaaagaggacacataaaatactataacaaaattagactacaaaaaaacctaacactttttcttatcgaaagacaccattagcattatgacgagtcaagtcacacagtagtacgaaatatttgcaaactgtataaaagccaaaggccttatattcacactatgtaactcatataaatcaattaagaatagtctgaaaactcctttctccaaaaatgacaatagactgacatacacttcacaaaagaagacatccaagtgtccaacaaaatatgcaagagtgctcaacttaatttttatctgggaattcaaattaaaaccacaatgtaataccattatatacctactacagtggataaaaagaaaaagacaaataataccaaatgttggagaggatgcagaactattcatacttttagtacactagaaattgatgtaatggctttgaaaacaagttgacattatattctaaagttgaatttacatatactctgtggcccaacaattccaagtcatcaaagtcatgtgaaccatatttatagaagcatgttttacatgccccaaactgggaataatcaaaatacccaaaaataatagaatggaaaaatatactcatataatgtggagcaatgggaaaataaaacgattgccaaaggatcaaaataggtaacacgaacatagtgttgaatgatagagacagaaacaaaaaaaatactatagtgttatatttgtaaaaaatttagcaatagacaagactgaagtatggcattaaaaataaatgtgatagttccttttgagaaggagagaatgaattaagttctgtttcttcaagctggtggtttcaagggtatattgtctttgtgataatttattgagctatatacttagggtttctctattgtgttatacattaatgatttaggaaaggttttcaaaataattaaaatttttgtcctaactatatggttttaaaagatgtgcttcaaaaaacatttaatgtaggaagaaacactgtatacattgtcctttgtcactttttgttgcaagtttggaagaataaggtattatccaagtaggctacttgtaataggacttacccaggaagattttccttattagatattagtctttctaatatgccatcagatgaggcttgagactactccattttctgtagagttttaggaaaaaatttaagagtgactaaagatgctctgtagcctcaaaatctgttacagattttgaggttctgttacagaaccgtggcagggaggttaatttaggtactcttctataaatttttcataaatgatatctagtagattttattctttcccagccttcatttaactccctccacgtggctgtgtagcaaaccatccaatttaaatgggatttatctctcactagcttcatgattgtgccaatgccatttattgcatcgtcaatgtttggtaaggagtgggcatgtataatagtgtattatacaagccttggaactgctgcgttcatttttgttcctaagaattaaagaagcctgaaaataaagttggtgcgtagtgttatgcatagtccagagaatcataagaaaatgtagctaggaccctgatcagaccaaacctggaacttttcttcctttggactttgggaagtgtcttagtgtgcttgggctgccataacaaaataacacagactaagtgggttaaacaatagaaatgtattatctcccagttccagagggtagacagttcaagatcagggtaccagttgttggtttctggtaaaacctctcttcctggctctgcaaatggctgccttcacactgtgtactcacatggcctttcctccatgcatgcaggaagagagggagagtatgcaagttctttggtgtctctcctttaaggacattaattatatcagatcagaatcccatgtttataaacttcatttaaacctaattatgtcctaaaggccctgtcttcaaatacagccacactggggggttagggctttaacatatgaatttgagaacacaattcagttcataccagggagtgtaaacttcatgtagatctcttctttataccagtttgagttaggttttctgttacttgcatttgaaataatcttaactaatagtgctcctaaggtacagtaactcttgcttaacaaccctcagaagtttgaccaatttattctatgcgtgtattatttaccacattcagccactgggcttttgatttttcatctttttcaaactgatgacttgaacatataagcaattttttctttttaatattcatatttttattgcattttaagttagaagtgtattctgttaatatgttcgtttgtaagaaaaaatcctttaaatgtcatgaaggtataaaattgaaagatagtttgtggaataacagttattaggaggtaaatttcttcatttcaacacaatttccctgtttctaacatttttcagtgaaatataataatatgcccaaaccatcttttaaaatatgtacttaagacttgacatttatgatcagttaacctcaaattgctataaaatagcgacaatattatctctttttacaattggccaactagattaccaccagagggtatttatttgtcacagcaacctgcattacaatgtaacgttatagcacactatgttacttatattgaattcttttaattttccctaaatgagattacctaataagttccatttttttacattaagaatcctttcaaaatgaccattttatgaataataaaatcaagttattgaaatatctctccctaagtttttatgcttcccttttttattcctgtagctgatatacttgctttttaatgtttgttttctttctttctttctttgttctttttactccctatttcctttgggtggattgtactgaggggtgttgaacctttcagatcttttgatattattatcgtacagcatatttttttttgaaaaagaaagcccaattattcccccatcaatatctatatcatggagcataaaagcttttgcataatgtgataggaaaagaagacctgaaagaaagcagtagatacttattttttctgtgacaaatttgccacagtaccaaattaaaacatactagtgttcaatgatacccattaaaccctttgatttaagagatagagaaaagctaactggaatacacaaacctacaaatatgtcacttaacataataaaagtttacaatgcttctgtgtcacatcaagtccagtgggcaaaaaaggagccagtggaaggtgtagtaggctgttcttgcaatgctataaaaaatatctgagtctggataaattataaagaaaagagtttaattggctcatggttctgcaggctttacaggaaggatggtgctggcatctgctcaacttctagagcagcctcaggaagtttacaatcatggtagaaggtgaagggggggcaggcttgtcacatggcgaaagcaggaacaagcaagagagttaaggaaggagaagtgccacacatttttaaatgaccagatcttaggagaactcactcactattgtgaagtcagcatcaagccatgaaggatcttttcccctgacccgaataccaggccccacctccaacactgggattacaattcaacctgagatttgagttgggacaaatatccaaactatatcagaagggatagcatggaatacaggacactgcttcacatggtcatttaagaaattcagatgatggaaattctgtcattcttcaggtgtccaagattgtcaataaagacggagactctctagtagtcaccaaaggaagaatataactttttaactatgctgaataaatatgacaaatatttattgtttgcctgtttgttttgctttttagcaaagcaagtgttcttaaactgttttttgtttgtatgtatattttttaagagaactgtcacttttgtttgcaatgtaatttattagaaatcaagaacatttataaagtattaccctatataaggataataatgccaaatgagacattcagtattagaaaaaatgatgttattcaaatcaatttaaaaaccaatttagggaggctgaggcaggagaatggcgtgaacccgggaggcggagcttgcactgagccaagatcacgccactgcactccagcctgggtgacagagcgagactccgtatcaaaaaaaaaaaaaaaaaaaaaaagaaaaatcatttatttagcaaaaatgtattgacacctactatctcccaagtagtaacatatattttactggatttttgatatttactggagattatgagaatattattttaaaaatattttcttacactgtttattgattttagtagccaagtttctacgtcacgttagctcttttactgctaacctaataggaattaccatagaaagcatctgacacaaacccttaaagtgtataactccttgtttcaagaaagtgagattatgaaaattgtatattttatgttgtccttatacatcattacaaaaacgataatcagttgagtcataaagtttagataagaaagaatttaagctcctcatgagaaattcaactagtattcccgtctcaaactgaatctttattatgtaactcttaaggaagaggaatgttgtgaattattaatcatataaaaatacattttggtatttaagttgtatctactgaatataagtaacttttctatatacactattatttgctacgacagattttctgaaagaaactgttgacaggatctggtatctggatgtaagggatgatataattgaaatgtaaattgtttttaacattttagctggaaagtaatggtgaaacagagaagtcaggggaaagggaagaacttgcaatttaatactttgaaccttagacagtttacttcaactctctgtgacttagctttcccatgttttaaatgaacacatgacagtatgcttgatctatcacctgtaattttaggaattaaacaggtaattcatgtaaaacactcagcatagtgcttggtacatattactcaatagatgttagttgcttttctaatcatgaacattattaatggttcagcttggacatggtaggtttgaggtgatattaatatttgtatcacagttcttaagggtatgatggtctgactgaaattcagaaaaatgaacccttagatcatatctaaagtgtccattctcagtaccatattttaagagttacattggccaggtgcggtggctcacacctgtaatcccagcactttgggaggctgaggagggcagatcatgaggtcaggagatcgagactatcctggccaacatggtgtaaccccgtctctactaaaaatacaaaacaaattaagtgggcgtggtggcgcacatctgtagtcccagctactcaggaggctgaggcaggagagttgcttgaacccgggaggcagaggctgcagtgaggctgagatcaccccactgcactccagcctgggcaacagagtgagactctgtctcaaaaaaaaaaaaaagttacactattattccaggtataacaagagaagtataaccactatgataataattcagactagagaagggttcctcaaccttggcaatattagcattctgggctaggaaaatgctgttggaagggcgacctatatattgtatgatatttaagtaacatcccactagatgcctgtcaagtgatgaaacccaaaaatgtctctagatacactgccagatatcgcctggagaacaaaaacattcctggttgagaaacactgtacttgaggcaatcctgcatacaagaaaacctgtatattctttaaatatataaagaagttttagcatacagcagactgattttgtttaacctagaaggcagacacagcactggttgataaaagttagaatattggccaggtgtggtggctcatgcctataatttcagcactttggaaggccgaggccggcagatcacctgaggtcatgagttcgagtgcagcctggccaacatggtgaaaccccatctctactaaaaatacaaaaaaattagctgaggtggtggcatgcacctgtaatcctagctactcaggaggctgaggtgggagaattgctgaaatctggaaggcagaggttgcagtgagccaagattgtgccactacacttcagcctgggtgacagagtgagactccatctcaaaaaaaaaatatatatatatatatataaatatatattttcaaaatttgaattaactagaaagagaatgcactaacttgtcagtcagcaacttctcagctacaatgagtatttaattaggtgctggatcactatcagagctgtactgggaatttccttcctgggagggacttgaaactaagaaatcttttatagccctttcaaggataagatgctctcattttgacaggtgtaaagatgcagatttggaaatcatttaaattgaggtcgtagttgaaatcaggaaaataactgagctttctctttgggggcaagagaaaagaagagcacaattgcatgaagtgaattttaaggaatatccgtaatttaaaagagggaatttggaatgtaacctatattcatttaacctatattaggttaggaagtattaaggaaaacaaaacaaaacaaaatgaaagaaagtattcaggagagagttttaaagaatgaatgattggtattgtcaattgagaagttaaagtctgataatagagaaagcaccagtttatacaatttctagaaaatcatggtgactttctgttgaaagcaaattctgagaaaagtgtcccctaaaatattgaatattacataaagggtgctatgttaaaaaatcacttgtatggttggaaaggttagtatcactgactttttaaaaaatagatttcctttgattctggaggcgggattagagaatggatatggaaacagagtgattatgggatggatagtgggcacacttagagctgccagcatatggaaaggaaaaaagtttgaggcttaagtagctggatttgtattttggtactacgacttagtccgtgtgggactataagcaattaacttcaaaatctctgaggactggattcctcttttctcaaataagaatagtatatactatcttgaaggatttctaagactaaatccaatcatcgatgtgacgtactagcacagcatctggaatgtgcgcagcactcaatggatagatgttaaaattgacattgttgttatcgttgtcattgaaggatattctaaggtcttctgcttcaaatgaggcataggcaaggagaaaaaatatattgaagacttgacaagagtggaaagtgtcaaaaattgccactgcttatgagtgacttaagtgatgaacacaatgattaaggatgagaaccaggtttttcttgtaatgtccagtgaccagcgaatttgtagtgtcccaggtctgttcacttctgggtcttctcatagcataatctatgaccacagagcaaagaaagggaaaataaacagtgatacagggttgagattgattaatgagattcatgtaaatctctgtcattttgagatttgtcaggcttgagttacttctaacaaagtaccctgcattatcatagtttattgcatatagtacctaatatattagaccacatgtatgaacattgtaactgacttatttcttaaagtaaacattagcatatgccagggtttctcagcctcggtactactgacattttgtattgctgatcctttgctgttggggacagtcttgtgcattgtagaattcttgcaacacccctgcactcctctcccagttctgacaaacaaaaatgtctctagacattgccaaatgattgccaaaagggttgggaaccaaaggttattttggttatttaatatgttcatacataaaggttatttaatatgttcatatataatatgttcagatgtaatttaatatgttcatatataaaggttatttaatatgttcatatataaaatagtgataaaaataatataaatgtacatgtgtgacgtttggatttataaaatttccatattttataactcataatagcaattctaaatagattttggttgtgatttctgttgcttcataagaccaatgtaattataaatttacattccttctgacagagaaaattctaaatattgaccataatctatagcaagaaatataaatattttttctacctgtacattttggttttgagagaacattttaagcattggaaatttatcatatttttgattgtttacctagacaaagttattacttatatatatatgtatttgagtctttcatgtactgttttttcattacatagttcaaataagttttgagcaaaaattatttgtgttttattttccagttgtttcctatccttattgctggtggctgctgtggtatggaagatcaaacaaacttgttgggcttctcgacggagagaggtatcagtaatattatttaatcttttgtttaaagatttaagcaaatatatggatctctattgtctgttaattaccatgctctcttggaatgcagaatttcaaatcatttttacatactaatattcaaaaatcactctagtattttttaagctgtagagcaaactttatcactgtaattttaagttagtatttgtaaaagcattggtttgttgcaaacagtttctaaaaatggtattggaatttatagtgaatacaattattatgtttaaaaaattttgtaatatatttaacaggcatttagttatgctataaagacatactttatttttcataagcgtctgttgaaatttaaaattctgagtgataaatatttatttttggtttttgaaaaatattttatctcctagaaatttattataacattctttttttgggaatcaaatcttttccattttctgattatctaataatccaactctgtttaaagagcacatccattggataaatttctgtattagaattatttttctcgtaatcctaaaattgatgaaaacaataatattcttacaaaataacaactgattatataaattgtgtatattcgttaatcgaaaggaacgaagaaacaaaatcatctgaggagcaaaagtatgcagtagatttattgttcatacctcatttattcaaaaaactagtttctgtttttatcagtattcttttattataatgtattctattgtattaatcttaatattttatttgctattgcatttctccatatatttctatatggatggtttttgtaacaatataaaacaacagtataattgcttaccttcttttttccacataaaaaatataatatttaaagacatgtaaaaataatccagagtgttctaagctatagaattagtgagtgatatgggttcttcttagtctatttttaagcacccatcaaagatcagtactatctataatatatttgcaaactggagtccctccctgtcttcaaataaatcattcatcttaatactctctgcctctctgattttctgtttatggccagtgcagcatcagtgagggtttacttggaatgactgtatgttaaaaagtaatcccatggaaaaagagcttattaaatataaatatataactattaggcaggaagtggaattctctgcagaggtaaacaatcttctagacatgttagatgatctattacagtaaaattatagattcaggaaggaaaaatcataattataggcaggtagtgtgaaggccttccttccctaatggaataaggcaagtgacaatttatgtccttaatcattagaagagaaggctgaatcaatcagggagcctctgttcccattgcatcctgaggagcactatttaaatatctgatctctaaaatttataaaatgcatctatgtaaatatagcattgtgaaaatatcaatttgtaagtaaaaaatatctgccattaactggcagctgaatgtaagtaagttgtctagttaaatttccttacctcttaaaagaaggatttgtaccctagagctaattctcagttgtggtctagtcttttgagccctataaatgtttacatgtagtagctaaagtttagaaatgatatttaatatttgttaaaactaatatgaatagtttagctataaaactttcatacttctcaaaatgacaaattgattttggctaatattgtattatctcagtgtagtaatgctgtttattacatactaatcaggtgctctggcaagttgatactacttcaatttttaaaatatagatataaatttatcttttggaagtcaaaatctttcaatatatgtggtagatgtggaaaggataaaagacaaatagtagaggggagctagattaggatcactttccagtttttatctgtattattaatattactgtgttctctggaaattcctttaatataatgcccttctttccaaaactcatccaggtagtgcttctttctattaaagtgtataatagtgtttgcatttaatttgctactgcttccgaaaaagaaaatgtatcttgagggtttatgttatgctatagcattacatgttaaaacatattttgaggaattttctgaaatttaattttactaaattcctttaaatgtaaaattctaaatgttatagaaactattcatatattgatgtccaaagtaaagatgacattgtctttgatgattattaaagatctgcaattagcaagtaattttaatattacaattgtccccccttatccatagtttcagttagtcaaagacaattgcagtccaaaactattaagatattttgagagaaagaaatggtgggggaggtgggaagtgacagagagagagagaccacattcacataaattttaggacagcatattattataattgttctatttcattattattgtggttaatctcttgctgtacctaatttataaattaaaatttatcattggtatgtatgtatagggaaaaacatagtatatatagggcttagtagtatccacagttttaggcatcctctgggtgtgttgaaacatatttaaaggggaactactgtgttaagaaattgtttttcattttggtcttaagagccctggagatttttaaccacactagttgtagttatgtgataattccatttatagactttatgtgagtggaggtaaaaatgtgtttatatctaatcctctctttattcagttttaaatattagattaactgtaatatttcccaaaggaaaagaacccactattatttctttatgtgaatgttactgtctcttcaaaacattgaagaaatcaattattgtaaagctcagaggacacctttgattagtaaaatgacagtttatctgttacagtaaatgaaagttacttaaaggattcttcttagaaattatgtagttttatttcagcagttatactagttgcttttctaaatgtaatgaaagtttaaaatgaaaataatctttggaaatgttttaatatattgtgttcattcaactagatgtgttactttttaaaccaaagttttgttttctcataaacatagatatactttttgtggcataattttaaattcagaggatagttagtcatgttatgacttttgaataacacccctgagaattcaggggctcttaaacacacattaaaaaaatgaaactacacacaaaaggcttcaattttgatatgaccccttcatacactaaccccaaacaaatttctgtggtgttaaaaagatgaaaactttcttttgggatgcgctaatgaatggaaacaataagtgtatattgataagtggaaatatttacactagaaagatgaattcatttatatagcttgtcctttttacagcggtattaaaaacatttagcttcaatggcacattcagttatagtcatcacattactgaaatatttgtcaggagcaagtatatgtaaaaaggagtctattgagctatttttatgcttgataatcttcattcttaatctgaaatttgaatattaataggtatcataaggcagaaaaatatgaagatattataattgttccctgcaatgaagatatttgatcatatatttggctatcgtgtgaaaatatgatgcatattttaatagttacaagaagttaatttttttccattttgagttgtttaaatgtagcatgtctctgtgaaactttaactgcaaaatctgtagaataatagatccataggcaaaggaagggttatttttacattaacttcatattactagtgagtctgagtatttgaataatctctacatttcatgtgatagcaatttttccatttttaattcttgtaaatttacagtttttttaagtttaaaaatattttaatgtagaactttaccacactactttttaatatttctcacatattacacttctcttctgcttcaaaatgaatacaggaaattttggaggataagacatgcccaatgagggattgaatttatgttcataataccctatctccctgcatattttgtaatcatgaagaataaaacttagatttgcattttttattatcaccctgaaatttgagttaaaaataataaaccaatacccacaagtagaattttagtagctttgagtaacaaactggttttccagaggcaaatacattagttctttccttctatacctgttttactggtacaaatccagacaaaagtaataatattaaactgtactttaataatgacattttatggtgtataaaccaattagttataaaatattctctgacgcagtgataaatagattctcatctaagtaatattaatgcaatgtagcagtgttttataaattaaactactcttttctccttagacactaaatatatttacagaaagaagattcggcacagaataaaaacattaaggaaaatgtgaaagtgttattttaggtggataaattcaaattaactgataaggtactgcctgcaaccttttgtagaatttcatagcacttcaaagttctgtattttgtaaatgtttaaacattttaacatatagataaagctttccattaaacacatgctttttaaaactcgttagtaaatatttcactcaaataaatgcctttgcagttaatggccacaatgtcaacttactgttgcttgtcatttgctttttattgaattgcaaactaaaatgattattattgtattaattttcttcctttatcctatgagactagaaattacaggtcttccgcatgcctattgcattatcatactttcaaaattttaacataaatttactttaaaataacttgagaagtcaaatatgtatgcagttaagatttgaaaaataactgatacttaccttgtaaacctgtttccaaagacttcatggtaaatatagtgctttcattttgctcagttcaacaaaggtgtatcaatttcttgctatattatagacaaattgataaatactgaggatataaagaaaaagatataggccccattattggggaatttgtagttttaaaacatttcaataaggcagacacacacacacacatacacgtgcaaagttcttaggggagcacctggatttactttattgtgatgtcatgcatagggagatagaatatatcgaaaagttttctggaagtcagattagtaatggaagtaaatgtgaactgtttcataattatacacaggattaatttcaaaaaaacccctaaacaaaaaaactttgggcactgtttttactgtatatacaatacaacaaatttgtctaaaatcactttttctttattatatgctattatctttatatttagacccagttacttagactaaaacattatattgatttattctaaaaaatgtagtctcgctaaccacaaaatcttatctgtattatatattcaaacgaatgtatatctcgatatatgtgtctgatgtttatgtgtgtatatgtgtttttatgctaaaaagttcattttttatctaaaatgcaaacttaaccaagtgttctgtattcttatttgctcaatctggcaaccctattttcaacacaaatgctcaccctggagctcaggggtgggttcaacctcataaaatccacaggaactcagagagaagtagaaaggaataattttctaaagttagaatcttgatttgttttcaaaataagggggagttatactgggcaagcaaaaataaaagatgtttactccgtatattatctatcaaaattaaaaactctttgactcaatggttagatttctgaaaatatatcttaaagatatatatctgcctagcttttcaaagtatactcatatatagacacttacagagagatttttgtatatcagaactatttcatatcattcaaaaagattcgagaaagaaattctgtgttcttacagtgggatattaggtaactgaaaaaaagaatgaggcatatttgtgttaatattaaattagtttattccttcaacaaatatttattgaacaactattgttgtttcaagcacatttttagacaaatacagcaatgaacaagccaaataaaatcccagccctcaaaaatgtttacagatcttaaaatctatattattaactggaaaatatatgacatagtttgtatgatgtttctatttgtataaatcacacatgcacaagcataatgtgcatggaaattgtgggtctgttggtatttgataaagaagattgactgtgttatttgataactataatataaacaaatagtcaaataatgggcaagttgagagaacatgatctaacattttaagttaggcacttaataaaaatagtatttaattttcacactaaaaatatatatatttgccctttacctatataaggaatttgtggagactagagtgcaatgctcaaagcttacaactagtaaaagaagaagctgtaacttaaaaccaagtctgtcagaccgaaccatacagagaactttagagatagcctgagtttgaacaagttggtttcataatggaccacttataatgtaacttatgcatctgtttgttgtactggaaatatgttatatttcatctgatattatgacacaatcattatttgatgtaccacttacgaagaaaacacagtacttattcaactattgcacaatgttcacttcccactcagaatatttattttctacttattgaaagagctcttatatgattatttagatataattttgtcatatgtcattcatatttatacagagaggaaaataaaagcaaaataaattgggtaaagttttgctacgacttattcaccttcatagtccaagtttttaaaaatcactttttgagttaagcaaaaatatattgtatgtttcacatagtatcattgactagaataatgaagtttatgtctgtgcagacaatgaaaactacatcacaactgtcatctggccagcagtgattatataatgtcattgattttaaaacacattagagtttagagatattaaaatgtgaaaaaatgtttcttagaatcaatcaaatatggtagaaccttctttataaggtgtttagtactaagcgaattaatgcatactaaggggttaccccactgcattttacctaacagacttcaataaatattagctgttattgatatgtaatataaagaatgatcagcattatacattaatattactaacaacaactcctgtatatcttggactcctcctccatttctactgtaatgcaatggttctcaatctagtaggcccttgagaatcacctgtggatctttaaaatgtgtgtgtgcgtgtgtgtatctgtgtgtatgtgtgtatttgcatgccattctactgttccatccccatcagatatacaaaatcagaatttctgtgagtgaggctcagccaagtgtgtttattattaaagccctcaaatgttctaatatgcactattggcctagaaacactgctttagcttctactctgacagagctgggaaactgtagaagggtttccaacaaacttgtaaagatatctgagttaaaaggatctgattttaagctgatcactgtgcttctgtgttcactccaagtaaaattggtttatggagaggagttaaatttttaatgttaagtttggtacatctactagacatctaattagatctatcgaagaggcaggagttgcatctggcatgaggaaacagagctgagtaggaagctaaatttgggaatctcagcacatagatggcatttgaaaccctgagcctagataaaattacccagagaggaggattaagccctgagacattcaaatttaagaagtcagagagaagacaagcacccagcatgaatactggaaagcagctaccaatgaaggtggagaaaaaccctgagcttctggaagccaaggaaacactgtataaaaaggaacagagttatcagttgtctaaaaaattctggtggttcaagtgaaataactgaaaattgaccattgtatttagccacttagaaatcattgctgaccccaacaacagcaattttagtggactgatggatgcaaaagtttgactgaagtttgatgagaaagaatggaacaagatgacttccagaatggcagcaagaggatcccctgagacctattctccagacaaacaacgctaactagtgaaaaaatctttaaaaaacaaacaaccgactgggcacagtggctcatgcctgtaatcccgacactttgagaggccgaggctggcggatcatgaggtcaagagatcgagaccatcctggcgaacatggtgaaaccccatctctgctaaaaatacaagaattagccgggtgtggtggtgcacgcctgtagtcccaagtacttgggaggctgaggcaggagaattgcttgaacccaggaggcagaggttgcagtgagccgagatcctgccactgcactccagcctggcgacagagcaagactccatctcaaaaacaaaaaaacaaaaaaacaaaaaaaaaaaaccatttaaaatacctggaaatagttttaagtgcatacggaaaacaaagaaacacttgttactggtggagggtcttgagtatgagttgcccgggtccttggagatttggacaaagtattgaacaaaatgcacaaagtagcagaggaatgaaatgcagcaaagaagcagcaaaagcagaaacttattaaagagagaaagcactccacagagtgggaggaggcctgagcaagctggtcaagggcctggatgcaaagttttctgggttttaagtacccaatttgaggttcttattggctaccccttatctggaagaaggttttgtctgtggctaaaggctgaggtgaattggcagcccatgcagataaagggatggtccctgctcggcctgtggcctatccaaggcactctccctttccatctgagatgtggcggaagggggagggctgtagggagagtagcttttgatcctttgttactcagcttggggagagggttctttttttctttttggtttagttttaggaagtttgtattaattggcctcaggttccctgcccccaaacctaggcgttttccttttgatccagctttgggaagtcagcatgaattggccctagattttctgcccccagaccttggtgttttctgttttagaaatttgctcaaattggccttaagttccctgtctgcagaccctattttcctgcctcaaacttatttaagaaaatctactaattctcagtaagaacagcaaatctatagcatttgagcctcaacttgctcccttcctacccccttctagctcactgtgactagcacttctcatccccccagctcccttttgcagatgctatattccagacaaaatcagctgaggcctgaggctctcttcttctaatgagccccacttgtatggcaagaagctcttctcaaggcatagcagcctgataataacagggacccagtctccctctctccaccttgcttatagggcagaaatttcatgactggcgagataatatgagaatataaaaaagtaacacctctgctcaacaccctgctcatgaagcaggaacattatttaagagagttatgggccactgtccccatcattagctctagagcttgcacaaactagcaaaatcaattcaaaaagataaaatctaaataaacctatagcaagcacagagattgcatttgttatttttaaatttccaattagatacatcaacattctgtttgcaacaagcacatctagcacccagatcttgttttctaatattagagaactctttccagtggttcctccattcctgacatactctcattcttggtgtttgtgtgtgtgtgtgtgtgtgtgtgtgtgtgcgcgcgcgcacgcacgcacatgcgcaacccttcttacgttttggtaccataagaaacttcaggtttagcttgtacacttcttgccccagtcctagaattagctatttctccaaggatctctggttccctttattttagcatacatattgcctagatcttgatttctaaataccattcaccaataaaaggagcttggatgcaaatcacatgagaatctcaatagatatagagaaagcatttgacaaagtccaacaaccttttaccataacaacacccaacaaattaggaatgaaaaggaaatcctcaacctgataaaaggcatctgccaataacccacatctggcatcatacttaactttttttaaatcacttatatcaggaacaagtcaaggatgtccactctctctaattctattcaacattttactgtatatagtagtcagagcagttaggcaaagaaatgacataagagccatctagattgggaagaaagaagtaaagctatctctatttgcaaataacatgttttgtaaataaaattctttagaaatccactaaaaaacctgttagaactaatacacaattttagcaaggttcaggatgccagagcaatataaaaatcagttgtatttctatacattagcaatgaaaaacctgaaagtaaaactaaaaacgaattcaattcaaaatagcatcaataagaataaaatacacaggaacaaacttaacaaaagcagtagaaaacatatgctatgtgtattagtccatattcacactgctaataaagacatacccaagactgggtaatttgtaaagaaaagaggcttaattgactctcagttccacatggctggggaggcctcacaatcatggcagaaggtgaatgaaacttattcactatcatgagaacagtatgggagagaccctccccatgattcagttaccttccactgggtccctgctatgacaggtgggaattatgggagctacaatgcaagatgagatttgggtggggacacagcaaaaccatatcactctgaaaactataaaacattgttgaaagaaattaaagaagacctaaataaatggaaagatactatatgttgatggattcaaagactttatgttgttaagatgacagtactcccaaacttatctacaaattcaacatgatacttatccaaatactaggtagtttatttgtagaaattgacaagtagatcctaaaatccacagggagaggcaaagggccctaaacagcaaaaacattcttgaaaaagaacaaagcttacacttcataaattcaaacttactatgcaagtatagtaatcaagatggtgtgatatggacataagactggacatttggatccatagaatgtaactgagaatctagaaataaactcttacatttatagttgattgatttttacaagggtaccaagacaattaaatggaagaaagattcatctttgcaacaaatggggctaggcaactgggtagccacaagcaaaagagtgaagttggacccattactcgtatcaccatacacaaataaagtcaataggaatcgatacaccaatatgtgacacctaaactataaaactcttagaagaaaatacagaagaaaatcttcttgatctttcagaatcttcttagacatgacatcaaaagaaaaggtgattaaagaaaaaaaaattggaattcattgaaattaaaaacttttgtgcttaaaagacaccatgaagaaaatgaaaatacaacctccagaatgggagaacacttttgcatatcatatatctgataagatatttgtatctacatatgcaaaggactcttccaagtcagtaatcaaaaggcaaattacccacttaaaaatgtataaagaatttgagtaggcatttctccatataatatatgcagtttgccctttgtattcatggtttccacatctgtggattcactcaaggattgaaaatattctgaaaaaatgttgaaaaatataacaataaatataaataaaaatacattataacaactatttacataacatttgcattgtattgggcactataagtaatctagaaatgatataaatgggaaaatgtgcataggttatatgccactatgacaccatttttaaacaatttacttgagcatctctggattttggtatccttgcggggatcctggaaccaatctcctgcagataccgagggacaactctgtgtgtgtgtgtgtgtgtgggtgtgtgtgtgtgggtgtgtgtgtgtgtgtgtgtttgtgtggtcagtaactcatgaaaatgaaaagatgctcaacaatgttagcattagcagaaatagaaatcaaacctacaataagataccactaaatgcttgtgatcgataataatgttattattattcaccaataatcatcaccaattatcaccaaaatgttggtgaggctgtggagaaattagattcctcacacattgttgttgaatatttaaaactgacactttgtagtgtaatacactctgacaattccttgcaatattaatgtttccatatgacccagcaattccactcttaggtgaatactgaagaaaaatgaaaacgtaggtctatataaaacttttacgttaatgtttatagcaccattattcattacagctttaaagtagaaatatcccaaatgcctaacaactgatgaatggacaaataaaaggtgatatatgtgtaaatggaatattattctacattaaaaaggaatgaagtactgatgcatgttataacaaagaaagatccttgaaaacattaggcaaatctaaagagacagtaagtaaattcacggttgccttgtgctgtgcttgggtatttgatggaatgtggggccagatggagaatgattgttaatgggtacatgggttctttctgggatgatgaaaatgttttaaaattagactgtggtaattgttgtacagctttatgaaaaatttaaatattattgaatcttatgctctaaatgggtgatttacaaatttctttgtagaaattgacaagcttctttgttgaaatggtttggctgtgtcccacccaaatttcatcttgaattgtagttcccataattcccccatgtcatgggagggacaagatagagataattgaatcatgagggccgtttcccccatcctgttctcatgatagtgagttagttctcttgagatcagatggttttataaggggattcccccttcactgggcactcattctctctcctgtccccatgtgaataaggatgtgttcagttccccttctgccatgattgtaagtttgctgagtcctcccagccatgctgacctgtgagtcaattaagccgctttaccagtctcaagtatgtcttgcacaaattgggcttaagttcataaccagtgtgagaatgggctaatacatttctagaaattgacaagtagattcaaaaacttacatggaaatgcaaaggaccctaaatagcagaaacatttttgaaaaagaacaaatttacagttcctgaattcaaacttactacaaaactatggtaatcaagatggtgttattatactacacagtatatttcttagttcttttgtgttgctatgaaagaacatacctgaggctgggtgatttataaaggaagaaggtttatttgcctcatggttccacaggctgtacaagaagcatgggaccagtatctgcttctggtgagcgcctgttaaagcaacagtgtaagattctttatattgcataaattactgtggaatgatagtaatatagtttccctgaattttgttgacaggatttgacatgttaaaagttgagtttgcaggtgataatgctacctgcattccatattaacttcattcatcattctgtaaattgttgcttaaaatatagaatttccttcatttaaagaattatgccataatttgcacatccgtgctgagcaattctcttcctaccaccacccacctccccttacaggggaatttgtttgctaggtatatactgttaacaggcatttatatacagatttaaacctaatacagaattcagcagtatgtattttatatataaagtttcttctcatgagcttttaaaatatattctactggttctaatttaaggaaaaaaaagctttaaacaaaataattttattgtgatttgaacatagttataatgctttattaattttctgaaaataaatttagtcatttaacaatacatagttgtcttagtaactattttgtattttatctcagaataaaaatatgtttgcaataatagcatcctgaataattggctttcacaataattcaaccacattgtaaggaacatggaaataggtaatatattgaatgacagatattgtgcatactccatcactagcagtggttcactataacagtgattctcaaccaaagaggatatcttaaaataatataattagaaaaaaaggcctagtctggttgattttgatatcctcattagataagtaattctgttctcctcatgtccaagaatcacatctgtactggaaatcatgctgaactggtgttcgacctgtactgtccttatctataaattacagggtattcctgctgcatagtatatttatttatttttaaattattttgatgccagcataattatggtctaatttagtttattgtcattcactgaaatgattcatgtactttaattgtgatatttaggtaaaccattattagagtatattgaatgaacatggtattagattcatgcatgaatgtaatattgaaaatgttaactattatagtatattaattatttccagtctgaaatccactgttactatattgtaacaattatgaagcattgtaaccagtactttgaacaagggcagtcaatcaaagcttgattctgtattcccacagcccattcaaactcattttctgtggccaatttgttctagttccttgagtagctagaattgaagataatttttttcttatatctctttttaatagatgtatgtttttcctttccttggcaatttggtattataaaattttattctattaatggaagagatttttagaagtcatctcctctttattggaaataaacatggaaagtttgctatcaaatcaagcattatttttataccttgtacatgttttcatatctatttttaataggtgatatgtctatatgtttcagagttcaacattgccaccagcattacccacccactcaattattctctcctctctatagccaatcagtgttatcagggcttttttgtgtgtgtatagttttctgaagttattttatacatacagaagcaatatgaatatacatctttttctacattacttacgctaataatagcatattctttataacctgtttttgtatatttttgcatgtaactgtaaagttctaataaattattataattctgaattattttgcaacataaaaaataatatttcacatctattgatgagaagtcaaaactgtacaaacttattttcattatagtcacattttgaacactttatatctttatttctctttactatttatttctacagtggagcatttctaatgcacttagaatattcttttagagagatatttttaagaattccaggataccaatccagctatgtaattctgagaaataatttttagaaccacactacagtggagtacctctcaaaaactacatggctctaactcaagtttataacagtaatataaggaaaatgactgagaatttcagtaggaaatttaagatgcagcaagctaaattacagtcttagagaattaaattaaaatgttggcaaactgctttagatcatgttataaattctatgaaatatgacaataatgtaaaataataaaaaaaggcttctgctactttttccttcatttaaatgaatgtgtgtgtgagtttgtgtgtgtgtgtaactgctttttatgttggtgtagaaagactatgtaattgcatggttattatgttatgcaagtatacatttgtaccatgttattgtgttgagtaatggtacagacttacggcattcaagttctggctttctacctatgcatttatagcaattaatatttattactttggtcctaatggcttgctttggaaattaacttagaatgacttagaagcacacactcatcaactactaatagcttatggtacaatagcatccaaatttcaaatctatacttggtaagtattttcaatcaaactatgtaagattataattaaaaactttaaaagtcgttatatattttgcaaatttaccatttgattatttttattatttattattgccatcctaaatttttctactagtataaaagtatattttgttcttaaaaatgccaagttattgccataaaataacattaatttccatagacgtacaggttagcaagattctactcagtctatttctctaaaattgtttgagtaaaagtgttagcttcttatttcttatttctattcatgctgaagtagtgacattgtgaactccaatgacatctataattggtaaattatctttgactttcagaaaacacataattgtttaaacaattctatacgatagctatagttttctttttttcattcttttttttattattattggagatggtgtcttgctgtatggcccaggctggtcttgaacacctaggcttaggcagtccttctacctcagcttcccaaattgttgggattacaggtgtgagtcattgcacctgggcaagagctgtagttttctaatcaaagtgcaagaaatatgctattcttagaagctggttttgtgttatatcatttaacatgaaacacgtatctcctgtagatgtggacaatttattattactttcagaatagttatttgcctaacagaagagctaacataaattaagcagtaaatcagttttgcttcctttagataattagtaatttacatataacctttggctattcttttatcttaggttattgatataagttgcataaaattgttttctatgtagaatgttctttgaaatgcaaaatctaattaaaatgcactattttaggacagttgagttgctaaatgatattacggagactattatgaatattttaggaatctgagtggagtatgtaagaaagctaaattataacctctatggactactttaggttactttatcagtcggctgaaacaaggaaaactgcccaggtacttagattattggatttttttacatatactatatttagaaataatgcaattatgactgtattatgatacctagacagtttcacattaagttacacattaatgtttgcaagatacactaaggttagtaaaggaggctaattgtggctgtagttattctgcccaggggctttcacatgcaccccaggaggctgctcaaaacaatgagtatcaacacatttataatcacttaatggcatacttattgatgaatcatattccaattactaacaaccgaaattcagttttgtggaaggcatggtaaatgatatacctgtttgtccagccaggacaaacaatgagtatttgtcaagagcctcctgtttgcttaacaaacattgtttagcaaggacccaatactgggtaaacaactgttgcatttagttttcaaactgaacatttcttaattttatagtgaagattgagtgtagaatcttatggtagctgtgaaatggtatgtagctaggtgattattatctagaatcttaatgtattaaatcacagtttagtgacgttaatattttacaaattaaagataatgcttttttagactgctgtccttcttttcctttaatatgtgtggtaaagtgaactactgtgttttaattactctttgatgtgtattgggataagtttttctaaatgaaaacatatctcattttgtcctgaagattaattcaaaattagagtttgcctaatgaaaacttttccatttaattttgcagatctattttatgcagaaatttatatcaattaaaagtacatatcacatgatttagccagggatggcatgcatgctagcaacctattaaaagatgaagaattgttaagattcatttcacttttgctgtctttgttgatagttttagtcttttactccaaaattttaatcatatactgattcaaattctatgttgatttgtaattttagaataatgcaggaactttttttaaattttgttaaaatgtacttattttgaatgtttcctaattagtgaattacctgctcattagtgaacaactaggaggtattttaatagcagttagtttaatgagaatggtgaaaaccaaatacattctccaaaaaatcttggcaaggagaataatgcataataagtaacagtcacaatgtctatgatctctttttgtttaacctttataaaacctgtatagttttgctacctgatgagtgaaatatttggtggtagcctgagtactgtcatcctttatctagttgttattctacttaatacgtctaattattgtgcttagaattacttattttttcttaatataaatgtttgttggatttcaaatgaaggtgactttgatgctgaaagctgacagttaatggtaacagtggaataacgttttatgaatgtaggtacgtagaatcatgcctggcagaagctattgtcatacatagtaagtggccagtgctcttttgttcaggctattaaatcatagtgatatgtgttatttcagctagaggaaaaagagaagtccttactcaatattgaaattcacaagatacagaataaattataattggtttcatcttttttatgttaaaaatttaatatttaaagttaatttaattatctgaatacaggaatgctaaacaatttaagtatatccattgaaaagaggatgcccaattactaaagctatgttctttttgctttattaaagattttaaagccagcaacatcactttggtagtgatattttcaggtaatattgatcataaagcatatatattcatgtctacatgaactggatattatcttaaatgtctttgccagaatttagattctaaatataaagctctcagcaagttcttaatgcttggaaaaaattcagcttttgtcttagcaagaatgtgaggtagtgcataaaaaacaaatgtaggttcttctatactagatttttaaaaacgaaatttgattttggagtgttaggttttatttcaatttaatttaatttttaaaataagtaatatattaacataattcaaatttaggaaaaaataaaaagttataaattaaaaagtttcacatttatctataacctagtccacactttccctccctgccttcatagataaacacttgtttattatctatccttccaggtttcctttatcaggatgttgcatattccaatatcaacatatgcaaatgtgtaaacatgtatccctcctttattatacaaaaataatatatttctgtatttcgttaaacctgagttcagacaatttgcacaacatttttgtgtaccaccaagaaagaaaaaatcttggcaattaaagggtgacagcattgattataaagaacattgcaatgttagaaatattagaatgtgaaaaacctcatctgttagagttgaagaaatatggtatgtaccctctactacatattactcttgtcacttatcaatataacttggatatctttccattgccaacctcttttgtttcttttattataaatgcattctattttgtagtatgattataccctaacttatttagtccctataaacagactcttgatgtttttctttttcattgttatgaactttgtacattgttcattttgtatgtgtgcaggtataattataggataaattccaaatgggattgcttgcttaatggaaattatatttgtaatttttatagctatgagcagattaccctctgtagggttttaccacattattttcctaccaactgcatgaagagtgttttgtcaaactttggatttttgctacctgctaagtgggaaatgatgttttaaagtggttctgatttgcacatcttgaagaaaagcaaagccaaaaatattatccagtgttcaagggtggtattttctttttctgcaaactattcatgtcctttactcatttttcaattagattgttaatctttttattctttatttctagaagctctttaaccttgagtaggataactgtttgtctctggtatgagttgaaaatattttttctctgtttaccatttaattctttaaatactttttttttttttttaacaatgtattactctgttaaagctgctgtaacaaaataccataaactgggtggcttataagaaacagaagtatatctcatacagctctggaggctgggacgtctaagatctaggcatcagcagatttggtgtctggcgaggggctatttcctgattcatagatggcaccatacagctgtatcttcacatggtgaaaggagctagctagctttctgctggagtgcagtggtgcgatctcagctcactgcaacctctgcctcccatgttcaagcaattcttctgcctcagcctcctgagtagctgggattacaggtgcacaccaccatgcccagctaatttttgtatttttttagtagagatggggttttgccatgttggccaggctgatctcaaactcctgaccttgtgctccaccagccgtggcttcccaaagtgctgggatttcagctatgagccaccacacctggcctctgccatctcttttattaaagcactaattccaatcatgagggctctgccctcataatctaaacacctccccaaagaccccacctcccaacaccatcaccctgggggttaagatttcagcatatgaaattttgaagtttacaaactttctgaccatagcaaacatgaagatatatttatgcttgatttcaaattttgtaaacttcttttatggtttctggaatttgagtcataggtagaaagactcagcttacttcaagtttacaaaggagtttacccagttatggcttcatttttacattttgtgtatactattagcttggtcaccccccagtgacctcagtatccagattttcatgcccatctgtactctctgtattgactgtagatgggggctatgaatgctttgaccagtcaactgtggttggagtgatgtgttggtagttttatgtttagcccttaattatactgacagttgtttttcttccctctttggagcttactaatgagatgctcctttttggaatctagctatcatgtataaaggcatcctcagggagaggcctatatccagagagctgacactgctagagagtgacctcaactgagccctcagttaggactccacgtgagctctcatttgagccttcagttgatttcagacatcccgagcaacccaagcatagggtttattcataatttgagcagagctcagctgggatagcttatctctccccaacatggcaccggctgggccagcttcactggggatggagaatcttccacccccattaactaagagttcagcacaggctgttggctaaggacctcaattttcctccatatgggcctatccatatagccgctggcttttcttataccatggcaattgttttaataggaggcagcttctagtccttttatagactagacctataatttccacagtgtcacctgcacctgtattatattggcaaaatcagtataggaccaggtcagacataaacgtgtggaaaaatggattgtcctgctttttcatggaaggaaggagtgatgaagaatttctatctttgatctgccacacatttaaatatttgcttcaacttaccgttttccagatagctgttaggtcattccaacactatctattaatacattctttacccccatattttgagatgctgttattactgcatgttatattcccatatacttttgggctttctgttagcttctgttgaattacccatccagacactactactacattgttgtaagtattgagaccttccaatgtattttctctctagtaggctggctgcttctcattttttgcttgtgtaattttgttatgtattattttgctataactattttgctaaatagattttataaagggtttgtgactttctggagaaaatagcttggtatatttattgttagagttaaaattataaattaatttgcagctattacctttatgatattgaaccttctaattcatattcatatattcctattactattcctaataaactaatatttctattataaatgttatttataaaattataaaatattcctattcatataagacatatttctgtgtcttaccgtctgttctacttttgtgtctttagggaatttaaaaatgttttccttaagtaggttttgtatattctctttcaagtttatatacacacatagaaaaagccatgtattgtatgatgtttatatgaaatgtgaagaaaaagggaaatataaagagactacctagagatggatgttggaatgaagaattattgcaaatggacagaagtttggttttgggggtgatggaaatgttctaaaattagattgtgtaatgacagttatattactctaaatatattacaattcatttaattgtacattacagtaaattttactatatatatagtattgcagtaaaaatgttaaaagaaagtcatagctctggctacagtatggagaatggattataggggaacaagggaagaggtagggagaacaatttggagcccagggtataagagaaaatagttgtttggactacataggtggtaatagaggtggagagacagaggaaaatttaggatttgtttttgaggtcaaatatattgtcactgctgatagattggatgcaacgggtggggaaaaaaaaagactaattctcactctacaatctagggttttaccttcaaaaactaggtacatggtggtaccttaacctaaaccataagaactgggagagacaaaaatgtgagggaagttagacagcagtcaagagcatcacttgaggtaaagtttgcaatgcctaaaagagattcaagaggggaaggttcacatagcagttggacataaagacatttggatatacaagtctgagattccagagagaggtctgggattccagagagagttctgggctgaatctataagtttcctaattaataccataaaatttatattcaagatccaagtcttgattaatgttaaatactgtttgtcaggggttgtttttgaaatgggagagttccctgattccccttgcaggacatatgattggggtgtggcttgcctgtttggttgccctgcagctcaaactgcttgagggagggggagcatgcagacgggcagatgcagaggccaggtgagcgctttgggctccaactccactgtagtgtctaggggtgagtgtctgcaaccccagttttgcaaagctctttcagctttgccttccgcagaaggcttgagtgttaatcagtttaatggaccttctgccttattgcaagggtaaagaaccagtgtgacagatttctgtatcctaagctcttgccaggcatcttggaagaattggatcacatgtgggctcaaagggtgagtgcaaggttttattgagtggtagaggtggctctcagtgatacggatggggagccggaagcagggatggagtgggaaggtgatcttcgtctggagttgggccacctagtggccggactctttcctgacttcccccagccaaattcttctcagtgttcagatgtccctcttcttctctctttctcccctacattgttccattgtctgtctgcttgcctcctcatcaatgtcctcacttgctggtctgctctggagcttggggttcagggtttacatgggggcaggatgggggcatggctgggggtaggatagggagtgtggcaggccaaaaggcagctttggggcacaaaaacagaaatacctgttctcatttagggccacaggtatccaggcttgagggtggggtctttgccggggaaccgccctcttctacccagtatttccctgtctcctgtctgtgttattttcagagcagaagtctcagtgtccttgggaatgttacaactcagtgagcaagataaataggtaacacaaagtgttaaattccaataccaggtgaaggcagatggttagaatagccttcaccaaataggtgccatttgagctatcaagaatatgtagccctttgcttgatagataaattggttaggatgttattaaaagtcagtatgggcacagagaaggtccttggaaaatactagcagttatgacagtaccattgctttcaaaatactgaataatcaaatgccaggtatgtaattaagaaaagagttgaaagacaaagctgaaaagatacttctgtgtccgattgtaggagaacctgtgacagacaggaaagaaatgggtaatctaaacttctgtaaaccacttaaagcagaaaattctttgggaagtagttatctcaattatttcttgcaaaatcatgattctgtttgtcttacttacgataaaaagcaaactagcaaactacagctgcagttttatatgtataagtacagccattatatataattgtatatataatacatatatatgtgtatctatatatacaaatataactacagcaatatatataactacagttatatatacataactacatatgtacatgtatatatctataactatgcagatatatatatctacatatgtacaagtagttttgtatatataaaactacatatatataaatgtatatatatatacacacatgaagcatgaatgaaactctttgagaaaaaagcctatagttgccaatgctattccactaaaactaattccttcaaatttacttcacttgtttttaggaacttatatcaaaagacagtaactagtatatcattatcaaaaatatttaatatcaaatctaccatgtatcttaatcttttatattttctgcaacttgtactgaatatttggctgaaattccttgctaaatgtgttaccatctacttcaatctcaatcacatttaaatcctatgttacttgggcaccagatgctccttagttgatttctgcatgctgatttcaggagccctagaaattctctggccattgctgataccaaagccagttaaggtttgctcagccctgttattgactaccaatttcctacacatagggtgctggcacaagactttccatctgtctgcctttttaattttaaacatagcctattttctttgtaaaatattagaaacatctcttaaacaaaattgctaatagacaaatgtaaatcatttggaaatggctataacttgtggaaattggttgagataatatttcaaaacaggttattgcattttaggtctgactcttaatgtgaataatatgatgtaactaaacttatagatattttaaaatagaatcttagtaaacattgttgctttttccttgcaccttttaaactcattgttatagtggaaagtgcttaaacactgtttatcccaagaatttataaaatatattattttaaaatatcagattttaaaaatgatttaagtagagcatgtgatatatattcatcttttaccacttaatgttgagttttagaaaatatgtgttgttaatggaccatcgactttcaagtcattttgtttactaagcttgaactgagatttgagcaattatgtgtgtagtaaaacctttaaaacagaatgcattgcattaaagaatgttcatgttcatttgcaatgaagcagagaatagtgtcagaactctgccctaactaggattaagttgagaagtaaactctgtatactttcttgcatttattatctgaatgtctgaaattttagtgttgttgacatctggagtgtttttcaacatgttttataatgtgttttactttcatttcattgttcatcacgtagtcatttgccgttcctgttagtgttttccaagtgttagaaacctttttctttctgcatgctaatgtcacctacttgccacaattgcatttttgcaaatattcttttttattttttatttatttttcattgcatgtgtttaaggtgtgcaagataatgttttgatatacatatacatagtgaaatgattattataagtaagctcttacctttttttgtggtaagagcacctgaaatctactctcttagcaaattttcaatatacaatacagtatttttagctatatccttctgctatacatcagatctctataattagtcatcctacctaacttcaagtttgtactttgatgaatatctctccttttgctctgcctctctgcccttgaaaaccactgttattctccctatttgtatgtatttgaacttgttttaggtatcacatatagatgagatcatgcagtacttttctttgtgtctggttcatttcacacagcataatatcctcctggctcatctatgttgccacaaatgccagtatctctttttttaagagtaaatatattccatggtatatacaccacaatttctttatccattcatgcgttgatggacacctgagttgtttccatatcctggctattgtggataatgctgcagtgaacatggatcacagctagctctgtgatgtgctgatttcgtttcctttggatgtacgtatacaaagcagagagatttctgagccataggataattctttttttcattttttgaggaatctcaatactgttttcaataatagccatgccaatttatgtttcaattaatagtgtacagggttcacttttctccaaatctttgccaacattttttatctcttttttgtaatagccatcataacatgtgtcaggtgatatctcattatggttttgatttgcatttccctgatgattagtgttgttgagcacttttccatatatccgttagccatttgtatgtcttatttggagaaatgtctatttacattctttcccctttttaaaattaggttatttgctattttactattgagctgtatgaatctcttacatgttttggatatgaaccccttacacgtacatggtttgcaaacgttttctcccaatccattaactgcccttttcttttgttgattgtttattttgctatgcggaagtaacttaatatgatatagtctcatttcttaattttggttttgttgcctgagcttttgctgtgatacccaaaaaaattatttcccaggtttatatcagagagcttttccttatattttcatctaagagtttttcagtttgaggtcttgtgtttaggtctttaattcattttaagttgatctttgtgaatggtgtaagataatgggcattttcatttcttttcatgttgacattcagttttcccaccaccatttatggaagagactatccattccctattgtgtcctcttggtggccttgtggaaaataacttactatatgtgcttgagtttatttctgaagctctcttttcggttctattggtctatgtgttttaatgccagtatcataatatttaattactctggttttgtaatataatttgaaatcagaaagtgatatgtttccaactttgtttttctttctgaagattgttgtggctatttagagtcttgtggttctattcaaattttaatattgttttttctatttctatgaaaaatatctttggaattttaatagggattatgttgaatctgcagagctctttgggtagtatggatagtttgacagtattaattcttcaatccattaacacagaactttccatttatttgtgccttcttcagtttctttaatcaatattttatagtttttattgctcagatattttactttcttggttaaatttattcctcagtagtttattctttttgatgacaatataaatggaatgttttcttaattgtgtatctaatagaccattgttgatacaaagaaatgcaactgatcttaccatgttgattttgtaccctactactttactgaatttatttgttctaacaggttgtgtgtgtgtgtgtgtgtgtgtgtgtgtgtgtgtgtgtgtgtagccttatagggtattttacatgtataatcattcagtctataagcagttataattttattcttccttttcaattttgatacctttaatttctttttcttgtctgattgctcctgctagtactatcagtactatgtttaacagaagcagagagagtagaaatccttacattgtaccatatattagaggcaaagctttcagttttttcccattgattatgatattggttttgggcttttcataaatgacctttattatgttcaagaaatttccttctgtacctgtttctttaatattaaaaaaaatcatgaacagatactgaactttgtcaaatgcttttactgtatctttgacttgatcctgtggtttttatctttcatccttttaatgtgttgtgtcacatatattgatttgtgtatgttaaagcaaacttgcttcccaagaataaatttcacttagtcatggtgaataatctttttgttgtgttgttgtatttagtttgcgagttttttgttgaagatgtttgcatgtatgtttagcagcaatattggcccatagttttcttttctcgtgatgtctctgtcagctttgatgtcagggtgatactagcttcataagatgagtttggaagtattccctctattttcattttttggaggtgtttaagaattacggatattaattcttcttttaataatttgcagaattctgctgtaaattcatctgatcctaggcttttgttgctgttaggaggattttgattaccacttcaatcactttttctgtcattggtcttttcaggctatttcttctctgttcagtctttatatgttgcatgtttccaggaatttatttcctctagattatccaatttcttggcatgtaattgttcataatattctttatgatccttttttatttctgaggtatcccttataatgtttcctctttcatatctaattttaatgtcatcttctctctttcttcttctagctaagggtttattggttttgtttatattttcaaaaaaattttagttttgttaatatttcctatagtttttctcttttctgtttgattcctatgctggtctttattagtttcttcattctgctaatttttgattcagtttgttctttttctagtttcttgaggtgaggtatgttgtttgagatctttcttctgttttaatgtagacatttttcactttaagctttcttgttagattgcttttgctgcatcctataagttttcttacgttgtatttccattttcatttctctcaagatagtttttgatttttttcttgatctcatttccaaagcatttggtttcattttcacatatttgtgaactttcccatttttctactcttattgatttctattttcataccattgttgtcagaaaagattcttgatatgattttgatcttcttaaatttgttaagaattgttttgtggtctaacgtgatctatcctagagactattacatgtgcacttaagaggaatgtgtattctattactgttgaatagaatgttctatatatgttgattaggtctaaggtacagcttaaatttaatgttcctttattgaattttcatctggatgatctatccattattgaaagtgtagtatcaaagttctctatcattattgctgtctatttctctctttagttgttaatgtttgctttatatgtttatattctctgatctaagatgcatatatatgtataattattatgtcgtcttgatagaataatctctttctcattatgttgaccttctaaaattatattgactttctgtgattatcgttgaccttctttgtcacttgttacagtttgtgacttagaacctattgtcagatattagcttagcttccctgctttcttttggtttccatttgcatgaaatgtctttttccatcccttcactttcagccaatgtgtgttcttgaatcaaaagtgagtatcttatagatgaatatagttgaatcttggatttttaaaattcatttagccagcctatatctttttattgggtagcttaaaccatttatatttaaagtgataattaacaaagaatgagttactattgccattttgttaactgttttctttttgtgttgtggttcttttgttcctctttttcttgcttcctgcctcttttttattgtttgtattgctagattttaattgctgttcctttttcttttgtgtaacttgtataggtattttctttgtggttatcaaggggcttaaatatctaatagttataacagtctctgcttagctgataacagcttaacttcacttgcatgccagaattcactgcttttacctttcctctcctcacattatacactgctgatgtcacaatttacaacttcttatattgcagaaccattcacacaatttagttatagttgtatttgaaacttttctcttttaccttttatagcaaattaccatgtatctatctaccactcttacagtaatacaatattctttctgttcctatatgtttacctttgctaatgagtttcatacttggtgttcattcatgttgctgtttggcatcctgctgtttcaacttcagtgacttcctacagcatttctcataagaaatgtctagtggtgataaacttcctcagcttttgtatgtctgtagaagtctttatcttccctttgtttttgaaaggctggtttgctgggtatagatggcaatttgtttcttttagcattttgaatatatttttctgcccccttctggcctgtaatgtttctactgaaaaatcaactgatagtctgatggcatttcctgagtaacaagcctttttttctcactgctttcaaaattctctcggtctttaacttttgtcaaatcaattacaatgtgtttcagtgtggaactctttggattcatattatttgatgtacctgaggtttgctgaatctggatttctgttttctttcccaggtttggaaagtgttcagccattatttctttaaatactctttttgtccctttttcttttttttctctttctcatcctcctataatgtatgtaattgttacccataagtcccataaagctgtcttcagtctttttcattattttttctacttagattaatttctaatgacctgtcttcagttttgctgatcaatagagtcctctattgattttttcaattcagtcattgtaatcttcaactctatgatttctgtttgatgcattttaatattttctatcattttgttgaaattctcagcttgtcatgcattgtttccctgaccgtggtgtgaacacccatatgactgtttctttgaattttctcttgggtaaatcacacagctttatttcactaaggctggtttctggagatttatcttggttttttattcggagcatatttctttgtttcctgacttttattgacactctgtgttggtttctgcacagtctgtaagacaactgtctctccctgtgttatcagactagtgtcttttaagaaatgtacctcactaatcaattcagcaagagattctaggtgccccaacttttatgcttatcttaatctcttttttttcagtgatccccaattagtatgtgccaagttttgtcagtgccccaagacagacaagatagaagccagtcccttgagatgcatctggaaaatttggcatgttagatatgtattgtcagggagaagctgaggatgggagtttacctcttactcaatctgcactaagccaggaagaggatctgtgggaaattcctgcactctcatttgaactacacactctgatctagatgcatagttattggaagtgcacccattcaaaaatcacatgcattaaaactcatagaaatgtaaaaattaaatattaaaagtctagtttgatatatgtaaattaaaatatatatgtgcatatgtataataatttcaaactattgtaaaaagatatagctaaagtagtggataataatcagatataagtcaggagagagattgatccaaggtaaacaggtcttccattcttacaaagttcggaagatatgtaaagaaaccatcgacactaaacttttttttttattatactttaagttttagggtacatgtgcacaatgtgcaggttagttacatatgtatacatgtgccatgctggtgcactgcacccactaactcgtcatctagcattaggtatacctcccattgctatccctcccccctccccccaccccacaacaggccccagagtgtgatgttccccttcctgtgtccatgtgatctcattgttcaattcccacctatgagtgagaatatgcggtgtttggttttttgttcttgcgatagtttactgagaatgatgatttccaatttcatccatatccctacaaaggacatgaactcatcattttttatggctgcatagtattccatggtgtatgtgtgccacattttcttaatccagtctatcattgttgggcatttgggttggttccaagtctttgctattgtaaatagtgccgcagtaaacatacgtgtgcacgtgtctttatagcagcatgatttatagtcctttgggtatatacccagtaatgggatgactgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctcttcatgtccttcgcccactttttgatgggtttgtttgtttttttcttgtaaatttgtttgagttcattgtagattctggatattagccctttgtcagatgagtaggttgtgaaaattttctcccattttgtaggctgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctaggttttcttctagagtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgctcgtttttctcaggtttgtcaaagatcagatagttgtacatatgtggcattatttctgagggctctgttctgttccattgatctatatctctgttttggtaccagtaccatgctgttttggttactgtatcctggtagtatagtttgaagtcaggtagtgtgatgcctccagctttgttcttttggcttaggattgacttggcgatgcgggctcttttttggttccatatgaactttaaggtagttttttccaattctgtgaagaaagtcattggtagcttgatggggatggcattgaatctatctgtaaattaccttgggcagtatggccattttcacgatattgattcttcctacccatgagcatggaatgttcttccatttgtttgtatcctcttttatttccttgagcagtggtttgtagttctccttgaagagatccgtcacatcccttgtaagttggattcctgggtattttattctctttgaagcaattgtgaatgggagttcactcatgatttggctttctgtttgtctgttgttgatgtataagaatgcttgtgatttttgtacattgattttgtatcctgaaacttcgctgaagttgcttatcagtttaaggagattttgggctgagacaatggggttttctagatatacaatcatgtcatctgcaaacggggacaatttgacttcctcttttcctaattgaataccctttatttccttctcctgtctaattgccctggccagaacttccaacactatgttgaataggagtggtgagagagggcatccctgtcttgtgccagttttcaaagggaatgcttccagtttttgcccattcagtatgatattggctgtgggtttgtcatagacagctcttattattttgagatacgtcccatcaatacctaatttattgagagtttttagcatgaagcattgttgaattttgtcaaaggcctttgctgcttctattgagatagtcatgtggtttttgtctttggttctgtttatatgctggattacatttattgatttgcgtgtattcaaccagccttgcatcccaggtatgaagcccactcgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataacgagttagggaggattccctctttttctattgattggaatagtttcagaaggaatggtaccagttcctccttgtacctctggtagaattcggctgtgaatccatctggtcctagactctttttggttggtaagctattgattattgccacaatttcagatggtgttattggtctattcagagattcaacttcttcttggtttagtcttgggagagtgtatgtatcgaggaatttatccatttcttctagattttctagtttatttgcatagaggtgtttgtagtattctctgatggtagtttgtatttctctgggatcggtggtgatatctcctttatcattttttattgcgtctatttgattcttctctctttttttctttattagtcttgctagctgtctatgaattttgttgatcctttcaaaaaaccagctcctggattcattaattttttgaaagctttttgtgtctctatttccttcagttttgctctgactttagttatttcttgccttctgctaggttttgaatgtgtttgctcttgcttttctagttcttttaattgtgatgttagggtgtcaattttggatctttcctgcttcctcttgtgggcatttagtgctataaatttccctctacacactgctttgaatgcgtcccagagattctggtatgttgtgtctttgttctcgttggtttcaaaaaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaacgtatattctgttgatttggggtggagagttctgtagatgtctattaggtctgcttggtgcagagctgagttcaattcctgggtatccttgttgactttctgtctcgttgatctttctaatattgacagtggggtgttaaagtctcccattattaatgtgtgggagtctaagtctctttgtaggtcactcaggacttgctttatgaatctgcgtgctcctgtattgggtgcatatatatttaggatagttagctcttcttgttgaattgatccctttaccattatgtaatggccttctttgtctcttttgatctttgttgatttaaagtctgttttaacagagactaggattgcaacccctgtctttttttgttttccatttgcttggtagatcttccttcctccatccttttattttgagcctatgtgtgtctctgcacgtgagatgggtttcctgaatacagcacactgatgggtcttgactctttatccagtttgccagtctgtgtcttttaattggaggatttagtccatttacgtttaaagttaatattgttaggtgtgaatttgatcctgtcattatgatattagctggttattttgctggttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaacattggcccccactatcttctggcttgtagagtttctgccgagagatccgctgttagtctgatgggcttccctttgagggcaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccgtcactttcaggtacaccaatcagacgtggatttggtcttttcagatagtcccatatttcttggaggctttgttcgtttctttttattcttttttctctaaacttcctttctcacttcatttcattcatttcgtcttccatcactgataccctttcttccagttgttcgcatcggctcctgaggcttctgcattcttcacgtagttctcgagccttggttttcagctccatcagctcctttaagcacttctctgtattggttattctagttatacattcttctaaatttttttcagagttttcaacttctttgcctttggtttgaatgtcctcccatatctcagagtaatttgatcgtctgaagccttcttctctcagctcgtcaaagtcattctccgtccagctttgttccattgctggtgaggaactgcattcctttggaggaggagaggcgctctgctttttagagtttccagtttttctgctctgttttttccgcatctttgtggttttatctacttttggtctatgatgatggtaatgtacagatgggtttttggtgtggatgtcctttctgtttgttagttttccttctaacagacaggaccctcagctgcagctctgttggaatacctggccgtgtgaggtgtcagtctgcccctactggggggtgcctcccagttaggctgctcgggggtcaggggtcagggattcacttgaggaggcagtctgcccgttctcagatctccagctgcgtactgggagaaccactgctctcttcaaagctgtcagacagggacatttaaatctgcagaggttactgctgtctttttgtttgtctgtgccctgcccccagaggtggagcctacagagacaggcagccctccttgagctgtggtgggctccacccagttcagttggagctccctggctgctttgtttacctgaccaagccttggcaatggcgggcgcccctcccccagcctcgctgccgccttgcagtttgatctcagactgctgtgctagcaatcagtgagactccgtgggcataggaccctcccagccaggtgcggaatataatctcgtggtgtgccgttgttttagcccgtcggaaaagcgcagtattcaggtgggagtgacccgattttccaggtgccatctgtcacccctttcttcgactaggaaagggaactccctgaccccttgcgcttcccgagtgaggcaatgcctcgcccgcttcggctcgcgcatggtgcgtgcacccactgacctgcacccactgtctggcactccctagtgagatgaacctggtacctcagatggaaatgcagaaatcacccgtcttctgcctcactctcactgggagctgtagaccagagctgttcctattcggccatcttggcttctcctcccaacaagttcttttgacactaaacttttaaagtagatgtaaaaatatccattttaactattaaaataacaaagtttatcttccaaaccagtagagaaaacaaatagaacagaagtagtaatggagaaaggagaggagaggagtttattaattcaaattaaatgaaaaaaaggagaaagaaataagaaatgaaaatcaaattcaagtataatagtaaacatgataaatgcaaatggttcaaattcactaggttacacagggattatcagactggataataaatggaagttttcctttcttttttactaaaacacccctaaaacatgaagagacagtactgttgaaaatgaaaggatggaaaatgttaaacctgatatgtagcatcagtttggctctccggaatcattctagactgtcctcccttctcatccctctctcacccccaactctcacctcagctctatgccatggatggtgatttatgtatggactacataaatgagcctcttttgctgtgcagcttctgatggtctcaacctgtgggggacacaatctggagcttagagtgttggcagatagagaggtcagagcattgttctcctaagttccttcctgagagaccatagaatggcaatatgtgtgttcctctgtcaaaagccaaaactttagtaagatggccttccacagtattctgtggcctaggaagatttatgaatgcagagttctttctgctttcaaagctaagtgttttaagaaccaaaccctttgggaggaacaacaaaaattggggtgctttatgtgtggtctaagccctttgctactcatggaaaagctgggagtttggggttccttcccagtcattaggtgctgtccccaggtagggtttgtgtgtgagtgtgtcccagattttcctacccgtgttggtgtgggtatattcttattttcccagtgtgtacaagtctctcaactagtttctggttttctccaagagggattgatcaatgtgtagctgtttatttagtgcatctatggaaggagggaaaatcaagagcttcctattcttccatcttgcagatattaccactgcaaatgtccttgggacagaatggtagatataaaacaagtataagtaatttccttgcagtttttgcattttccatgtttagcattcttttcaaaggattagattgtgaattttcagtgctaaataagttatgactaacattccagctggtaatatattgatcagtagtggttgtgagaatggcaaatagataagacatagagatatgataagaaatataataaaaatgcatacctcaatggtttgtgatggtagatactggaaagaagaataatttaagatataattagactttgactataacgtattcagatatttttgaatattattaacaaacttatgatctgtaaaacattaacttctgccagtaattccagagaattatgtgcaatggttattagttgcataaagctggaggaatatttaaatgatctacttaaaattaattactctttgatcaataatcttggtcaaaaagagggcttcctatatcagtatggaaaatattatatttattcacattattttacaattatccttcctttttcattggattctcatttacttaatgaagaaaacacattaaattgttataggaactatatttcagtatctgttcctttgacagtaattgtattagagttccagacctcacacagcttaaattctcattgtacaaagtctactttcaaatgctttcaaaaagacaaaatttccctctcccccttattatttgagtgtaggatgatatattttcttggcctagatcatgatacatacttatgtctgtctttttagcaataatttttaacaaaaatttagcaaatctcattaattttgattgtaactttgaattatattgctttgatctaaaattatttatataacacataatttttcccaaaagtcttttggatcaaaaatgtcaaattgagtattaacgaaagattactctgttagtcttccacaagaaagatcaggagcccatcatggttagtaccagttttgtcagacagttccattgatgagaggccatcttcattgctcttctttattattttctgtgtaaaaccgaattctatctgacacagctttgtgttggttgtctgtaagttagctttaatatagcagtttgctttagcattgtcagattcacaatgtaaaatatactgtggcaaaataatacaatgttgtgttagttaaattaaaagcattgactcctccagccttaagaataaatctgaattgtagagcctgatcgttaaaagataatgatcatatactgccataggccacagaaatttaaaaggtcttagtgcttctttcagatagagatgcagagactaatttgaaatgaatacatagcctaacaagatgagtaggtttatttaagcacatgactgacttttgttcttcatgttgaagaggcttgaatctttagtgtcaccctgtttttaataatgatcttaaaagttcttttctttggcagtttgctttctttctgtgtattaacctttggttgtctaattattgtttcctttggtacatatttaatattttctgcttgtgctctttattatttgtgttctagatccattgcttgcccagtaagtaaatacatgaagaaaatatactaatactgtggagtagaggaagggaagaggaatatttatgaatattaatgaatattaataaaatctactacagtctattttatcatacatacttcccttccttttgtatataaaatatagtcacttcccacctgcctcctccaggaagaaactcaaaagtctcatctaattgtctaatcttaatagccttgaagtaaaaatgcaaattatctggctccccactcaccacattcaacattcaatgaggaaacagaacaagataatcataataaacacttccattgcaaatagaaagatggacacatatagtagtccctgaatactagcatttctgaactcctgttgatcagaggtttcaccatccctcttcctgtgtgagtggcaaatctttgctgaggttttctgggaacaactccctagttattgttcatgactcttggctctggcctctggcaaatccttctgtttcaatgatctcacttcgttatatctgaacagggcatttgagaatccgtcttttttggatctgagcactgagtctgaaactatgaaaggttctaggtaccactgtactagcacgtacaagatatgcatgtatacgtgtatatattaatacatacgtgtatacacactaacatgtgagtacacatacacaaaaatgcacacacacatagtagcaatatcttgagatctctggtttggagatagactctttactcacatagtaacctgtgtcacttccctatacctcaatttcccacaagataacatagtatcagatatatcctgcacagaaaatggggtttatgacacaggagagttactccaaaattatgaatcttggggcttatatagggtaattggcacatgtggcccttctgccctctggagactagagagggaagcttctctagaatgtaagcaaatcctctcggagaagatggagaggtctctacttcaccactctggaatgtaaataaaactctctgagggagatgtccataaattttcttggaaatttctatctttatcatacaagacttatttgatattcaatcatttttaacccatgttacttggaatttttgttcaggaagctctgaccatgcagaaacatgaaatattcgtggagcattgtctcctgacattgtgtagctttctcaacctttcttctacctataactttggtccaaagaaggtccaaaacgcgtatatactttggtgggaatctcacttatttcagccacatggaaagcagctgattactcaaagaacttacaactaccatttgatgattgggtatatatcccattactgcacatgtatccaaaagaaaataaattgttctaccaaaaagacacgtgcactcttattttcatcacagtactattcacaatagcaaagacatggtgtcaacctaggtgcccattgaaattggagtagttaaagaaaatgtagtacatgtacaacatggaatactatgcagccataaaagagaaaaaatcatgccctgtgcagcagcatgtatgtagctggtggccattttcctaagctaattagcacaggaacagaaaacaaatactggatggtctcacttctaagtgggagctaaacatttgatacacaaggtcgtaaagatggcaacggtaggtactggggactactaggggtggagtgagggatggagaggcaggatttgaaaaactattgggtactgtgctcactacctggatgatgggatcagtataccccaaaccttagcattgtgcaatatacccatataacaatcctgcacgtgtacctcctgtagagatctaaaagttgaaacaaacaagagatcgccagtgatggtgtttcttgaaatataattcatacaccatacattttatccatttagtgtatgattcagcagcttttactatagtcacaaaattctacaactctacaactgtcactccagttttagaacattttcatcatcctaaaaagaaacaacataaccattagcagacccacgcagctctaccttactccaccccgctaagtcctaggtagccacctctactttttgcctccatgagtttgcctattctggacatttcatgtaagtgaactcatataatatgtggtcctttatgactagcgtcattcacttggtgtaatattttcaacattcatccatgtacattttattgccaaataatactagaaatcatctgttttatttctctagcaatcagtttctatttatccaggatggtggcacttttaacagcagagcttcctcaaaacataattgcttttgttgttgaaactctatatatttgattatagtcagctacatgtgcctacttacaattctttttagggaatgtcagttcctgattctctgtttctctctgtccctctttcttatctaactatctgtctgtctgtctatctgtctatctatctatctatctagcttagtccattttgtgtcactataaccacagactgggtaatttgtaatgagtagaaatgtatttcttagagttctggagcctgaaaagttcaaggttgaggggcatgcatctagcaagggctttattgctgcatcatcccatggcagaaggcagaagggcaaaagaatgcaagagtaagggagccagaaggggctgaacttccttttataataagcccattctcatggcaactagcccactcccttgatatgaacatcaatccatttatggggtcagggacctcatgacgtaatcaccacaaaagatgctaaatagccaaagcaatcttgagcaaaaagagcaaagccgaggtatctcacatcctaatcccaaaatctatacaaaactacaataattaaaacagcatggtattggcacaaaagcagaaatatagaccaatggaacagaataaagatcccagaagtaaatctgcacatttatggctaactgatctttggcaaaggtgacaagaacacacaatgggggaaaggacagtctcttcactagttgatgctgagaaaactgtatgcccacatggagaagaatgaaactggactcttattttatcactttaccacaaatgcctacacttatatgtatgtacctcataatacattgttgagatcattgtatgtgtggaaattatagtatttttccaattaaaactatatcataaacattctcaatacatctctattttaatgatataattgaacaattgtatctaaaatttgcattgaaacaaaattggtgtagacacttccttgtaataattctgagatggttgtcaaatgggtagttttgttgtttaaattaaaattttgcttacacttattatcattatcctgttttaaaatgaaaatttaattatcttattttttctacaggtagtatacaattattttcttccaaatatatatactttatttaatctatttaaatgacccaagagagatgggttttcataccttgctagaaaataaactctaaaacatattattaggtcagtaagatttcagatatctttatatttgatctatttatatcagctgtgacataattcatatttcttttattgattcagaagaaataaaactatactttcgtatacctatgagtgatttagaattcttcttggaagagggagaaacacttagttattctttgatatccaaaagcaatagtacttcaagattctaagtactataatctatacatatatatgcatgatatcatatgtgaattctatattataaatacttaatattttatatttctcacatattacagattgtataattgatgtgtttttaagccaaaatttagcagattttatgagcttttcttttttaatctgggaaatttcatctttgctttaataaacttgctcaaggactcagaatttgagttaggtatagtgtgactatgggtgggtcttaatttgcatatcctaatgaggaactgtaggataagaaaataattcttcactaatacttgttttttgttttgttttgttttgagactgtgtctcactctttcacccaggctggagtgcagtggcgcgatcgtggctcaccgcaatctccgccttcagggttcaagtgattcttctgtatcagcctaccaagtagctgggattacagacatacacaactacctgcttaatttttgtgtttttaatggagatgaggtttcctcatgttggccaggctggtcttaaactcctgacttcaagtgatccacctgcctcagcctcccaaagtggtggaattacagatgtgagccaccatgccaggccagtaacattatttccactaaattctctaggtctctaaagagatcagcaggtggtttgtggctccaagtcaaacagagcttttagaggtacatgacatccttcttgagccttcttttcaagtctctagtcataagtttttcattagataaacattctattgaggtgtaatttgcatacagaacagtaaacaaatcagaaatatgtagcttgatgaattttcacagaatggacacttctgtgtaaccatcatccataaacattcatgtaaatcaatagaaacttgctggcaccacagaagatccactaagtctcctcccaatcacaggcctgtccaaaatgatagctgttctggcattttaattaaagtcatctatgggttactttgggtgtttgaatttttttctttccttcctcccttcctttcttccttcatattcttccttccttcccttttttcttacttctttttagctttaaaaggggtcaagtgtgagacactgatataatctatataaaattacgagttttcaactggaaaatatcaagcacacatgaattatatttctgctttgagtgtagactgccatgagatttgtaatattatatattaactagtgaaaatagttattaaaagctgttgtgctttcactttgaatttggtaatttattttccatttacatttttctgttaatatgttaaatttattaaggcagtagttaagagcttaattgttgtgcaaaaagaaaaacagggattttcatttccttgtttgctcttttattacactcccacttacttggagtggctggatctatttattatcttttccttttaagatctgagtgcacaataatatttgattcatttgagtctttttatacatgaaaatagcaatatggcagttgctcagttttttatatttatgactcagtattttatggattgattattattcacttgaaatgttacaatttggtctcaatttgaaaaggttagaattaattataatgaagcattagcgattaatcattagaacttaaaatcaaaatgtcagtatatttattgtgaaattgcttgaattggctgagaatttcactaatatatcagacaatcaccagtcctaactacttcatctcaagtcaaaagataacagcttttaaaggtttgttccaagttttcatctctgtggttttgtaactagaaaacaggtatgagctatagtaagtgttattcgtaaaagttacataatggtttgtatgtatattgtgttggtgttcggaaatgtgacgcccaaattatgtcattattcttttttttgagactgagttttgctcttgtcacccaagcagcagcgcaatgacatgatcttggctcactgcaacctccgcctcctgggttcaagcgattctcctgcctcagcctcctgagtagctgggattacaggcacctgccaccacacccagctaatttttgtacttttagtagatgcagggtttcaccatgttgtcaaggctggtcttgagctcccaacctcaagggatccacctgccttggcctcccaaagtgctgggattacaggcatgagccaccacgcccggcccgtcattattctcatttgaatcagttggtataaattatcatttaaataaatatatgactacatacaattttcaacttatggtaaacacaatgacattcatggattatcatgaagaagttaaagtagtcacaaatggaaaggaagatctttgtgcttttatcttagcaatttcacctgacatcttacagtagggaaaatgggcaaatgtcagtgagctgaagggcgtgtttagttggaactggctaaaaggtagagctaggacagtattggaaacccgtgacagtgagagtaattgacatttaacatgatagactatgggaagtttgtatgtagaaatatactttgttaagccttaaggtaatatgagagtattacttattgttataaatccatttatttttaagaatattagtttaagaatattattattcataaatgtgagacatcaatctttatcaaataggactagttattggtatcctaaaatcaagtgaaatttattgttactacaataattgatttataatgttacatttatttcctatttattttggttgccaataagtatgaacaacaaaaaaggttaaaaaaaatccttcactgtattgttaatttcctttggtattcacagctcacatctaacaaaatatttcagtcctaaatgagtttcttctagtttaaatagtctagtaaaacattttgattatatttactccaaaggatacatcattaaattattttaaatgtaaggtaataatttttctctatgtttactaaaattttttcctcagtagacgaatggttaccaaaatgatttgaggctctagtgaatcatgtaagttccataacacaaatattcatatgtaaatttaaaaactagttcaaattataatttattcataattacacaaaattattgttttatgaaaggttgagaaatgaagtaaatgtaatatacagtaatgtctatctatgtacctgcttatctatgttgatgacacaattttagaaaattgtatttttagatttactaaatatttatctgttgtgtgaattaaaatggcaatcgaatacaaatgtgggttaataatgatgaaatttcaattacaaaatatgagaaaaaactttgtaaacattacatgaaacaattcatttatgggagcttttttttttttttttttttggagacagagtcacactcttgtcacccaggctggcgtgcagtgtggggatctcagctcactgcaacctccgcatcctgggtcaagcaattctccattacaggcgcccactaccacgctcagctaatttttgtattttttagtagagatggggtttcaccatgttggccagactggacctcaggcgatctgcccacctcggcctcctaaagtgctgggattacaggcgtgagccaccgcgccgggcctctatgtgaactctttaaatttagacattttcaacaacattgctgttcatttctgtagtagattaaggtgtgttcatataactgaacttctaaactcgtgatatatagattatttttggcctaaacagtgttttaaaaatttaaaaagcttcacatacaaatccaggtatttagctgctattgaaagattgtaagacataagagcaatagacctaatttgaacatggtaagttaactagaggtgaatagttatataactgttgcatggtaggtgaggaaggaagaaatggggaagcaggctgaaagcaagcccaggcaagcgataaaacaatagcatcagcatattaacagcaatattcctttattcagtatagcagctctcagactgtttggtgtgagcatataactatagatatttactactttagaaatatagaaatttaaattgataaattgagaaatttactactttggaaatttaaattgagaacattttacattatttatttaaaaaaattatttatttatttatttatttatttattttgagacggaatctcgttctgtcgccctggctggggtgcagaggcgtgatctcggctcactgcaacctccgcctcccaggttgaagcaattctcctgcctcagcctcctgagtagccaggactacaggcacacaccaccacgcctggctaatttttgcatttttagtagagacggggtttcaccatgttgggcaggatggtctcaatctgctgaccttgtgatccacctgcctcagcctctcaaagtaaaaattatttttaaaataatgaaaaacccattcctattataataaataacatattctttataaaagtaactatgtcttttaaaaagtgagaagagtggctttgtttcactcttaataagtttctttaatacctgactcaatagaagtcagctaaattctcatacctgattcccatatttaatctgttttaatatgttcatcaggttgaggtgtataaagaaaatccagcctcacacagaaacatagttagaaaagagaggagtattttttaagtttttgcacgtagttgtgaatattttctgttatactttattgaaagttgacaactggtaatttcttgaagttggtttaaatatttttttacccatgcaagatttgctagcatcatgcattggtcctctggaaaatgttgattcactgagttatgcaggtcttctgaatattgacccatttcattttgtaataccaagaaatcaccaccaatataataagaacaagcttaaagtactgtattggaaagctatcaggctcacagtgtactataaaatttttcccaaactatgatttttgctttaccctcctattttatcattgccaacaaatacagtcagttattttccttcaagtgacagagttttttcatttttgtgaaaatatctgtaaaatatctaatgtgaatggtttgtgtgtcacttgtgctttcaacttaaaatggtgcttcatgaaaaaggcagctaaatgagcatgcaactcagtctcataagtgcatttccaggagacagttaattagttacagaaatgctgtatttgtacttcccatttgttatacttgagtcaagatttaataaaattaataattttactgatgcatcaaggatatttttaagtaaagtaaacccggattttttttgttattctacaagggcttggcagtgaaaaattcagtgactactagtagtttgctaacactgctttgatttgtgctaaggttccagcagttttacctatcattgctttttcaccatcactgcaaacatcagcactgtgcaaaaggcaaatggaaatttggaatgactaacaaaatagttttgacttagttgtatcctcaaaaagatgctttagaactcccaaacacccactgtctacactacgaaaactgtcactctataacaatgtgctaacttaaaaaatcaatattataaaaatataacatatacaataacgcaactgattttaactgtacagcttaatgaatttggacaaatgtatgtatccagttaaccaccaacacaatcaagataaagaacatttccataatctcaaaaggttccctcatgacccttttcattcactcctcactcccatctccaccccaggcaaccatgcgtgtgctttctatcactaaggattttattttgtctttcccagagtttcatttaaatagaattatgcagcatgtgtgtgtgtttttttcctgtcttccttctttgacccatcttaacaatgttgagatatatcagtaattttatgtattataccacttcgttcattgatttcaccaagttctattccaaaactgttatgaatgtttgtttagaagcttttgtgaaatttaaaaaaatttaacttgagtaaatgcctaatagtacaatttctggattttactgtaaatatgtttgattttattagaaaatgccaaaccctcttccaaaaggattgtataataccacatttcacctattccatgtgagagttccagtttctccgcatccttgccagcatgtagtattattggtatttttcattgtaactattctagtagttttactctagtacctcatagttataattttcagtttttgttggctaatggtattgaatatcttttcatctgtttctcttttgtcatgtgtgtcttcaattttttgctcatttttaaaattgacaaagtattcttattattgagatgtaaacggttcttatataatatgttctgggttataaatcctttgtcagttttatgcaatgcaagtattttccccaggtctataagcttgctttgtatatttttactacctttcaaagtgcaggtgttttaattttgatgaatttgataaaattttattctgcggtttgtgttttctttgttctacttaaggaaacgtccatttgatggttacaaaaatgtttctcccatttttttctaaatatttatggttttagcttttttatttgagtctatgattagttcaagttaatttcagagtctgatgtaaagtaaggattgaggttttttattttcttttttttttttttttttgccctgtatggatgtccacattttctagaaccattgtcgaaaacattatcctttccgcattgcatttcttacaatctgctctttttctgcttttgtagcatctcacaattttgatatgttgcattttcatttttttcatttcaaaataagttatatttgcccttttaatttcttctttggctcatgacttacttaaaagtattttgtataatttccaaatatttgacattgtttccaaatatatttctgcttttgaattctaattagttctgtattagacctcatatgtagaccacatacgtagaccatatacatatcattgtagtgctattggaaacttgttttatggctcagaatatgatctacattcatgcatgtcctatatatgttagaaaaaatcgtaattattgggttaattattgtaatgtcaattagattagacaatgtttgcttgtagtttcatgtcttctatattccggcttatgttctgtctgcttattctataatgtgacaaagagaagtgttgaaatatccatctataattgtggatgtatctattgctcctttcagttttgtcagttttgcttcatgtactttgaagttttgctattgcttgcatgcagttttaggattggtatgacttgttcatgatttaacatattattatgaatatccctttttattcgtagtattaactcatgttctggtctatttttatgatattaatggagccaactagctttttatgcttaatatttgcacaacatatcatttttctttctttctaacttgtctgcttatttaatttaaaagtagtttcttatagacagcatatagttgtaactctttcgttattccagcacagtaatttcttcctgcatttctaattgcagtgtttagactacatatttttaatgtaattatctatactatgtgtctcccatctggatttttcctctatattttcattgttcactttttcctcatttccccccttttttcaggctaattgagtactttttggatttttttttttttactattttcttactagatctacttttctttttgacaatggctctagagtttacaatatgcattttgaacttattgaagtaaaaggaggcctggcacagtggctcacgcctgtaaccctagcactttgggagcctgaggcaggtggctcaactaaggtcaggagttcgagaccagcctggccaacatggcaaaaccctgtctctactacagatgcaaaaattagctgggcatggtggtgggcacctataatcccacctacttgggaggctgaggcaggagaatctcttgaaccctggggtcagaggttgcagtgagccgagatcatgccacttcactccagcctgtgcaaaagagcaaaattcagtctcaaataagtaaataaagtaaaaggaaaactgtttctttactcacaatacttctgacactaaatgtttgggatttttttgtttacacacacaaaaaaactctctggacaccaacttagtgtcttatatgcttactcaattctgacactgactattcagaattagtgtcagacgctacaaggttagaggctccgtcctacaggcctgcccctcacttgaaatagcaatcatggccgggcgcagtggctcatgcctgtaatccaaacactttgggaggccaaggtgggtggatcacaagatcaggagatcgagaccatcctggctaacacggtgaaaccccgtctctactaaatatacaaaaaattagccgggcgtggtggcaggcacctgtagtcacagctactgaggtaggagaatggggtgaacccaggaggcgaagtttgcagtgagcagagatcgcgccactgcactccagactgggtgacagagcgagactccgtctcaaaaaaaaaaaaaacattgcaatcacaagtccagtcccaaatggctgataatttgctagaatgactcacataactcagggatacactttatttaaatttactggtttattataaggaatgttaaaacagatacaaatgaacagccagatgaagaggtacgtagggcaaggtctgaaaagttcctgagtagcttctgtctccatgtagtgggggtatgccactctcccagcacgtggatgttcaccaacctggaagctctttaaactgcagttttgagatttaatggacgtttcatttcataggcataatgaattaactcaatctccagccctgttcccctccctggaggacaggggataggactgaaaattccaagctaatgataaattagtctttctcatgaccagccctcctgaagttatccaaaagcccaccaagaattgcttcattagaacaaaagatgctaatatcgcctgggaaataccaagggatttaggggctttacattaagagactcctgtcatcccatcaatcaggaaattataagggttttagaaactgttttaggagctagagccagagaccaaacattagagcagacgatgctcctagtacccatatcacttaaaaaattacaagagttttatgggggcagatacatatttattattatatcacaacagtctaccctcataaaattttaagaaacttataatttatttccatttcaatgtataaaacttctgacaatttatttcttatactattgtgtcatacatttaacttatacatattttataagcatcatcataagcaggcatcaaatctcattcaagtgaaattttgagatgaaaaagttttgatatttatctaaatatttaccctatccattgctctccattgctttgtctagatttaagtttttagctagtatcattttccttactcctgaaaaagtttctttagtgttttcattagttcagataggctggcaacagattctttccacttaatatggaaaatgttttattttgcctgcagttttcaaagatatttttactgattatagaattctaggtggacctcttggaggcccttaaaaaatgtcttttctttttcatctttgtctagtttctcttgaaaaatgtctgctatcttgtatctgttcatctgcatataatgtgtcattctttcgatgtcatttctgggtctattgttttttactgacttatttttctctcattatagtcaatttcctgcttcttggcctaataaacttttatttgattcaagacattctatatttttatgttatttttgtaaatttacattactgaggatatgaatttggttgtatttttaataagcattgagttttgttctgctagacagttaagttacttgtgattaggtttaattcttttgaggcttgtttttgaactttattatgatagaacagccttgactgtccttttgtcttagaattcagcctactattaaggtatatccttttcgagttttctactgagtactctgaatgatcagcaaagactccactctagctggttggagctcaactgtcttccagccagccctttctgagctgagaaactgtgcaagtcaccagtttttggtaaccctttgtctgcctttgtgccttttaggatttggtaaaaattcaaagagatatttagagctctttttcagcatatatccatcctcttctgattgacaccctacaactcagcctctccacacttagacctcttactccttaagtcagttcccatttaggatacccttcctacatcacaggctatactatgctgcaagacagacaacaaggccaatttttgactcactttatttgtttcccttctctaaagaatcactgtgcttctctgcctattgtctaatacccggaagcaagactttcatagattttctccacttttctagttatttatggcgggaggttaaatctgatctctgttactcaattaagaccagatgtggagatcttattttgcttgattttttgtatttgcaattttctttctttgttaaatgagtacttgaaatatatgttaccaaagatatttatctcaattgtgagctttatacaggtcctaaataatagaggattgtaacattttgtattatttaaaatattaacttttaatgtaaattaacatgagggacatattagaagatggctgattatgcataacaactacttaccaaatacagattatatatatttagtgtcatttttacacagtttatacgcatacatcaatttaaatgtttttactaccgttattatctccttataataccttgactgccaaagtttttctgcatccagtgttgctatcatcttttgttcacgaggaacaatctgttctgatccctgggaattgagcaggatgtttggtttccctctccatctgatggtagtaatttgtctttcttacttacaaataatatactagatcttgatgatggaataagcttacttcttgaggaatgtgcaaacatgacaactaataatagaaatttctgtaactacagttagcatatatattttaataatacacctttgcatagattacttacatttattttcatatttatacatatgacccctaacttatgatagtttgatttccaatttttttgactttatggtgggtttatgagggaattaaatctatttcaacttacagtattttcaatttacagcaggtttattgggaaataacctcattgtaagtcaaagatcatcttgtatttcagcatattttattatacaacaatgaataattaaatagacatgtgccttttagtatgcatatacagaaatgcatcgaaaaaatatcagtgactctcattcatcaaaatattcaagccatgattgcaccactgtattcacctgggcaacagagtgcgatcagtctacaaataataataataataataataattcaatctgtttatcctatgctaagtatttccaacatttgtaatcctaattcctacagactgagttactatataacttagcttttggaaataaaaatgtgaatgagatgatctttactatatcagtaagaaagatgcatgcataatgaacaaaaaatgtggggatagggagaaaaagaagaaaattaaggatatttttatctgagtttattgtattcctatgtatcaaaagcctaagattcattttctgacattgttctgaaataaactgaaatgtattagggatgatttggattgttatttttgcaaatgtacactgttgtatattttgcaaatatttttcacatagaccctttaattgagaggcaaaagttcagatagcaattgtacacattaggctcgcatatttgattctaggaatgtacattttcagcaacacactcatagaaaaaaaatgcacagctgccaaagctgttaatgggagctgcatgctgaatttattgctacattgaaaatatatcccttcttgttcaacatattcagtcaaaaatgttcattaagaagtagtcttatctgcttttcattttcagggtataacacaagaatattatattccattaagagcaaatgtttaagtaacatttcagaaataaaataatgagtttttgcagtgctttttgggaaaatttaatttatgaaaaagaaaactcttagaatacagttgtagcatttcaatcttttcttctgtgcttgcaattattatgcaaatattattgctactgcaaaagatctttgtcatgaattgctttgtaatggggcaaggttattgagcactactttttaaagagatgtttctatgacagtattatacataagacttcaaaataaattgctaatggtaaaagactaaacaaatgcacccaccatttttatttctacagtgccagaattaaagacgtttatccaaatgctttaaatcagtttattttatattttctagccatgcctgttctagtaaacatgaacaatgattgtacacagttttcttctttagctgtcactaagatggtgtcataatgtttagagatacgctctctaactgtcagcgtttgttacagttcagtgatgcgtgataaagtatgagggacattgtcttcttgcactgctaaatgtattaatgcagtgatgatatttctcaatgactttttactcaaggtcaaaatgatgaaattcatctgtacttttcaataatttgtttattaatcaatatatttttcatcttagcctgttccttcaagttttttaggtacattttaaaatttgaagcaaatgtatattaaaatttaaagaagactgtgtcatatttttacatttaattgtattttaaattaccagccattatttttcaattcatcttttaaaataaataaaacagcatttagttattgttctttttgttgctacctatgaaaatataacttgagatagactctagaattctctgatctatttgaattctctgtttatgatctctggatataaaaattacttaaaaaatgataatcattatatgataaccattcatactatgtatttagtaattgtgtcttatttacataatcctttaaagtttacaactttaaattgcttgatttcacaagcaatagttatttttgccctaataccaattctatatggtagagactttaggaaatataaccccctttttacagttgaggaaattgagctcattgttgttagtaccctaaggtcacagatattgaacttaaatctagaattttggaccccaattccagtatcttttctttagttccattcttatttgttcatatttatagacaatctgcagattgtatatcactgacataaatattgcaatgtgttatagaataatgaagttactgataatgtaattaaatattcactgcttctggattagcatttctaaatcactattctagtgatgtaatgtcattattcacaaaacttcatggttcattgccaaccctattccttcttcgtatatggaaatcaccatcttcttccactggaaatattttctcagattagagatgccattgtttatagattttcaattactgtagttgatctaatttcacctaggagggtatatattgattataaatgtttacatgggataattacattttatcggttaaataggaaccagtatatatgctattggtttagtagcaatgcctttccaattacagcccacctttatatgatataaattgtctttattctttccccttagcatttttagagtttttaaggacatggtaatttgtattgaaagttacactactcagtggtattttccaagaagactctgcaaatcttttacattctgtgttactagcaatgtgatataaatcagttaacatccataaccgatagctactcatctacaaagagtcttaaagagtaaaacgtacaattcagaaatctgaactctggtgttaaaaaatcctcaagattattagagcaactaccatttgaaaaacagatctgaactatgaagttctgtatcagaattttgattttgaaaaatttctgtaggttaaataacaagaatcaagaacactacataccatacttttggacaaaagtttattataaccctatattataataggccaagtatatcacagtggattcattgttattactaaaagtatgcattcatagtttcagtcactttaattatcatacatggacaatgactagattttttattattaaagatatgtaaagtaaaatacataatatatcaagaatatacatcactgccactaaatagaagtgttttcattgttggaaatttaaaattatttacctattatgaaaacgttagttcttaaaaggattaggttcagcaagagtaccaacagattaaagctggacaactttggcattcctctgttttcgctgtcaaaaatacactttggactttgcaataagttcctcaatagttataaatcctagtagacaaaattgaaaaaaaaaatctcttcaagcttttgtttgctttactgtattataatggtaatagttactggggattatttttaaatttccagttgtttggatggcatgaactgattatgtgtatctaaataatatacttgtattattaatataaatattttgctaataaatatctttaaataaaatattataagttaagttgaaatgtttatctatttttatgttattaaaacgggttaacactaattcacgtgagttatggttggtgaaaattccaaattatttgttaaagatataattgtaatagagctatagagtcttcactctgtcaaaattacagagctttctccagaagcatcactgtttctttagttctcccgcaccctgctgacatgatgtggaatacactgagtatttgtcagtggagtagccaggatgggtgcagttgagagcactgctgaggagctttcaaggaaagacactctgctctgaagcaccagaagttacacccacagggaactttaccctaactcctgagttgaagtaatataggccattattataaaagaatgcttaatttagagttaaattagagttaaaaactattaaataaccgaataaatctttgtttttatgaatcactattttgtaataatcattaaaatggtgtcagtcctttaagaactcacattttatttttctatgttctgaaatatacacaaatgtattttattacacctaccctgcacaagtgtgattattttgcctgctttctcctattcatttttttttaacacagtacctgaaaatagggaaatgggcagtgtgttgtgggaggaagcaggggataaaatctcaaattttggcactggtaatatgagacagaaaggagtgaatctgagagtcaaatagttcgttacactgaggagaggtaaatggtgaaatatctggcgtccatagatccctcaacataagtggaaggaggatagatttgttcttacggtatccgtggcccactctgtacatttgggacaagtaggtttatggatgctgattttgtgagacgtgttgtttgtgagtctaatcatgtggacagaagataactgaccatagaaatggataactgacaataaaaataaatgtatttaccatgtattatgctatattctatgctgaatactttctaaaatagactttcatttttctttcaactttctaaaactttcagtttgtgagatgaataaaattattatccccattttataaatgaagcttgtagacgttatgtaactaccaagatgacaaagctagtaatggagcaaccgcaatgcaaacccagggtgtcactgttttagaaactgtgctcttaactgctacactctcatacagtctatggcctttccaaacttgcagttaaaaccaaattttagtagcaaatagaggaaatttaataaacgaatgaaagcaattgatttctttgaaaatagttttgcattgtagactgtctatgactacaaaaaaaagctttattttttctcttggtagcttatttctatagaagtgatgagtcagtgccttatcaagaattttcatttcttgcttgcacactccccaaaatggtacttgcagctatttatcattttagtcttatcagtgaattaattttggttatgattaacctttaatagagacagaatagcatggtggcttagagccagtttttcatcatgttattaaatgtcttttgagcccaattttttatctgtgaatcagggaaaataatagtacctcagttataaagttgtgcccacaataaataaattgctgtatgtagaggtctttgaacagtgcttaccttgcctaagcacacgataaatgttatttagcaattattgttaaataggattgcatgtcaaagttaaggaaaccaaagttgattctgttttattgaagttcaactaaatatcatcaacttgagttatatacttaaggaaccttcaaaatgtcggaatgaagactattttcattgtaactttaaattaataaagattaccctgaagggacaataataaatataaacattaatttgttctaaaattttaaacatgtacatgatatattacacaaatttagagtttcaaaatatgaatcttttccagccaacacagtaattttcaaaggacttttttttttactatatacctcttgataaaattagtgaaaaaacagcttaaaatggaactgattggattgaacatttgtatacctctgtgggtattgtttaattgcccgtgaaattgagttgttaaacaagcagaataatacatgtgacataaataaggtaaatcataagaaaattggaaaaataatttcgtatctaatgtgcaatccttaattataagtagtatttcgggcttacaaaatatatgcatttcctttggagagcaatttttatcttacttatctcgggttgtttagattctacttcagatattattggttggatattgtcaaaatacaacatttaaagttaaacagaggtagatatattagaaaatgtaaattgatagaatagttattttgtgtccttttaggatgatataattcagtaggtttagcataagtattaagtacacttataaattatttattaactactgtctttcaggtgtttatattctactgtgaagatatttgtagtgaggaaataaatattttttataactcatttttaattgatttaaaaagacaattttaatagttagatggtgtgatatatttccttaaatgctatcagttgtcatctaatgcatatagacataaaagtttattaatattaagatgattaatattctttgaaacataatttataatttaggataatatttcatctcaaaaaatcaaggccagtaatgtagggaattttattgacgggatgtgttaatcagagcaacctctccagtaaattttaaaatagtggatatgattttttaaaatttattaatagcatcaaagaactaaattgacaagagagatagtcattacaaggccaaaaattatgaggaagggggaattggaaaataagaagacaactgagggccagccatggtggctcacacctataattccagcacgctgggaggccgaggcaagtggatcacctgaggttaggagttcgagaccagcctggcctacatggtgaaaccccatctctactaaaaatacaaaaacttaaccgggtgttgtggcggacgcctgtaatcccagctacttgggaggctgaggcaggagaatcgcttgaacctgagaggcggaggttgcagtgagccaagattaagccattgcactccagccagggcaacaagagtgaaactccatctcaaaagaaaaaaaaaaaagacaaccgaggaagtttggcctttgttaaaactgttcgttcaacaaactcaccataataacctgttttagtgtgcaacttctttcttgccacagtgtttactaacatactgtcaacctaaataacagagagagattatctaaagatactcattctattctggagtgtgcagtatagatgctaatccaggatatgtggactatggggatcataggcatagccaaggagtttgagacaagaggaagctttcaaaggaaaaagtgaacgtaattcgttttaaaacaaacaaaatattgattacagtggcttatcacaggagttgatgccaggtccttgtggagacagtatgtcaggcaagtgttcttatgcattcactagctgtccttgtgactcatgtaacaagatgcagtttgaaaagtccttggcaaaagttctttttacaggcatatgtgcaagtaagagactttcagatgttctttgtaatagttcttatcataggcatgtgcgcatgagggccctcccttcctaacctaccagcttaatttttgacacaaatgactccatttgtggaatccaagtttgacacaaatgactccattttgatcctgacaactttcacatttcctcatttgatcaaggtctttctccaaaagcattgctgatcaaccatctcaagcatctcatagttaggttttatttctcagtgctggtatgatcttgtcctgattgttcagttcttctcacatcagtgaggatggtcagcaaattctgagtcagttttaaaaacactttagcaaaatggccgcaacaagtatgtttgaaaaccctgtatctctgattaattttgcctgaagtccattggtaagttccattttgttagttccaaaggtgttggctatcattttaacaaaaccggaccagtattattctattaggagtcttgctgttgcagatgttagacaggcaacaaagagatactgatctttatcaaacgttttgcctatgtctgttgagattatcgtgttgtttgttctttattctctgatgtgatgttccacatttagttatttgcacatgttgaaacacccctacatccctcatgtaaatcccactgtattattgcgtgtaatcttgttgatgctctgttagattcgctttgctagtatttctgttgatttttgcatctgtattcatcaggggtttttgcctatagttttcttattttgttgtattcttgtctatttttagtttcaggctaatgctagcctcataaaatgaattagaaaaaattccttcttcatcagttttttggaataattagagaagaatttatgttagttattttttaaaagtagtttagaattcagcagtgaacccatcaggtactgggtattttgttattagaagactattactggttcaatccagttactgattttatatatgtttgggttttctattttttcttggttcaatcttggtaagttttatttttcccagaatttattcattttcttgaggttttctagttggcatgtagttgttcatatttttttctaaatggtctttttgcatttctatgatatcagttataatatctcctatttcatttctgattgtttttatttgggtctccactgtttttttcttactctaactaataatttattgacttatgtttatcttttcaaacaactaggtttttgttttgctgatcttgtattatatggggttttctttttgtctgtattttgtttagttctgctctgatctttgttatttattttttatactaattttctgtttggtttcttcttgcttttttagttccttgaggtgcatcactacatcatttaattaaaatctttctacttttatgatgtaggtttctatggctataaacgtccgtcatagtactgcttttgctgtatcctgtaggttttggggcgttgttttctattttcacttgtttcaagatttttttttctctttaattccttccatgacccatcagtctttctggagcatgttgcttaatttcaatgtatttgtacaatttccagagttcttcacgttatttgtttctagttttactcctttgtgatctaagaagatatgtgatgtgattttgatttttgatttttcaatatttgttgatgcttgttttgtggcctaacatatgttccctcctggagaacatttcatatgctgaagagaagattgttttctgcagctcttggctgaaatattctgtatatgtctgttaggtttatttggtctataatgcaatttaagtctgatgattatttttgtttttctgtctagataatctgtccaatgctgaaagtagagtgttcaagtacccaactgttactatattgctgtctatattggtctttgattaatatttgctttatacatctgtgtgctccagtgcgtgtgtgtgtgtgtgcatatttacaattgtattttcttgccaaactgatctgtgtatcattatataattgccttatttgtcccttttgttcttcgacttaaaatatctattttgtctgatataagtatggtactcctgcatggttttgttttccatttgcctggaatatctttttctcatcccttcattttaagtctatgtgtgcctttagaggtgaagtgagtttcttatagccataatattgttgggtcttgtttttttttaatcaattcagcagttctgtattttttcatatgggaatttaaagtgtttacattcaaggtttttacttttctattgaaacatattcctgtcattttcttaatcattttctgattattgtgtatatcctttgtttctttcttacttttattatttgtgtggtttggtggttttctgcaatgataacatttgattcctttctctttctcatgagggtatctgctataccaatattttttatgctttttgagtgtttttataataatatatactgtatttttgcttccagatataggatttttaaataatatcttgtagggctgaccagtagtgatgaattccctcagtttttgcttgtctgagatatcaacaagcaaatttctccacatttctgaagagacagctttgtcagttataatattcttggttgaacactttttttttcttttcttctggcagtttgaatataatatataatatcattcttttctggagtgtacagtttctgttgagaaatctgctgttagtctgatagagattcctttagatacaacttgatgcttgatatggtttggatctgtgtccccatccaaatctaatgttgaaatgtaatccccgttattggaggtaggtcctggttggaggtgattggatcatggcggtagattcccctatcagtgccatactcgtgatagtgagtactcacgagatcttgtcatttaaaaatgtgtagcacctcctcgctatctttcttcccgctgtttcagctttgcaaggcaccagttccccttcagcttttgccatgattgtagccaagcagatgctgccagtcttcctgtacagcctgcagaaccgtgagccaagtaaacccattttctttataaattacccagtcacaggtatttctttatagcaatgcgagaatggactaatatagaaaattggtatcaagggaggcattgctataaagatacctgaaaatgtggaaggaactttgggactgggtaatgggcagtggttgaaatagtggaggcctcagaagaagacaggaagttgaaggaaagtttggaacttcctaaagacttgttagattgttataaccaaaatgataatagtgatatggacagtaaaggtgaggctgatgagacctcagttggaaatgagaaactcattgagaactggagcaaagttcacttttgttccttagcaaagcaattagctgcattgtattgttgccctagtgatctgtggaactttgaacttggtaatgatgatttaggttatctggtggaagaaatttctaagcaacaaagcattcaagttgtggcgtggctgcagctaatcacctacactgatacgcatgagcaaagaaatgacttgaaactggaagttatatttacaaagaaagcagggcatacaatttgggaaaatttacagcccaaccatgtggtagaaaagaaaaaccaatttttgggcaggtagggggattcaagtggactgcagaaatttgcagaagtaaagaggagccaagtaccagtagccaagacaatgggaaaaattcctcaaaggcatttcagagaccttcatggaagcccctcctatcacaagcccagaggcctaagaggaaagaatgcttccatgggtgaggcccatgcttatagccttgtgcaaccttgggacactgctccccacatcctagtcactccagctccagccaaggccaaaaggaccgaggtacagctcaggccactgctacagagggtgcaagccataagccttggtggcttccacatggtttcaagcctgtagatgcacacagtgcaagatttgaggctagagaacctctgcctagatttcagaggatgtgtgagaaagcctggatggccaggcagaagctggctggactgcaggttagagccctcatgtagaaactctcctagggcagtgcagagcggatatgtcaggttggagctcctacacagagccctcactggggcactgcctagtggagctgtgagaagaggaccaccatgcctcagaccccagaatgttagagccgactgtaacttgcaccatgtgcttggaaaagccacaaacactcaacagaagtccatgagatcaatcatgtagaataacccctgcaaagccactggggcagggttgcccaagaccttgggagcccacctcttgcaccagtgtgctctagatgtgaaacatgcagtcaagggatattattttgaagccttatcatttaatgactgccctacttggtttcagacttgcatggggcctgtaaccactttcttttggccaatttctccatactggaatgcgagtatttagtcagtgcctataacccctttgtgtcttggaagtaactaacttggtttttttttgttttttgtttttttttaaacggagtcttgctctgtcgccaggctggagtgcagtggtgcaattgcggctcactgcaacatccgcctcctggattcaagcaattctagtgcctcagcctcccaagtagctgggattacaggcatgcaccaccacacccagctaatttttgtattttttgtagagacggggtttcaccatgttggccaagatggttgtgatttcctcatctcatgatccacctgcctcagcctcccaaggtgctgggattacaggcatgagccaccacacccagccaactaactttgtttttattttacacactcataggcataagggactagccttgtctcagatgagactggactgtgggcttttgagttagtgctggaatgagttaaggcatggagattgttgggaaggcatgattgtattttgaaatgtgagaaggacataagatttgggagggcctggggtggacttactttgtttggatctgtgttcctacccaaagctcatcttgaaaactacttcctaatgttataggtggggtcttgtggaaggttattggatcatagggtagatttcctcgttgctcccattcttgtgatagtgagtgagttctcatgagatctggccttttaaaagtgtgtagcacctcccccatctctctttctcctgttttggctttgtaaagtttcagcttcccctttgtcttctgccatgattgaagctgagcagatgttgtcatgcttcttgtacagcctgtggaaccatcaaccaattaaacctcttttctttataaattacctagtctcaggtatttctttagagcgatatgataatggactaatataatgctattctcttactgtttttagaattctgtttttctctttgacttttgatattttaaatataatattcctcagagaagaccttttgagttcaatttacttgggaattttttaccatcttgtatgtggatgtctttatcttttccaagacttgaaaagtattctgttattattgtattaaataagaattttttatgcagctttccatttcttcccttcctggaactcacttaatgcaaatattggaacttatttgcataatggtatttcatatgtcacattggcctttttacaattttttttttccttttcctttttcttttttcagactggtttatttcaaaatacctttcttcaagttagtaaattctttcttctccttgatctacactgttgtcaaagctatcttttgtattttttattttgttcattaaattcttcgttttcaagatttggatttttataatgatatctattactttgtagaattatttatttagatcaccagtttttccctgatttctatttattgggtaattgtttgttcttttatctcactgagttttcttaagatcattattttggttttcatgcatttaaaacattttcttctgtggtctcctcctggagtattattatgttccttgggtgatgcaatgtttctttgctctttagggttttttgtgttcatacctggatgtctgtgcatctggtgtaactgttgtttcttccagtgttacgaaatagctttcataggatgtatttttcctttagatgtatttatagtgtcagttgaataggatactttggctttggttctgtgactgtacagtaaggtagtcttcatatgatttctttggctgtaatcaacatcagttatgtctgtgtgttcctcacggtttaggttgtggttgtttgtgtaggatgtggagtggatttgctggggacagggacatcaggcaggccaatccttgggtctctggggtcatgtgtaagtgcatggttgccactctactgaagggagtgggtttgctggtagcagcagtggtgagtcccatgtgtggtgagccattccatggggccatagagggcacatgtgaacactggaaggtccactgtgagccctgtgcaggctggccccacagcccctagtaccagaggtgcatagcagttccaccagtgaagtggactgtgtgccctgagcaaactgattctcaggcccctggcgagtacacatgagctttgattgtgtcaggggtgggtgctgggtgggccagtcttcaggcccctaggccacacttgcaagcatccgtagtgctattgacagactccaggcagtctgatcctgaggcccctgggtggcttgcatggatgctgtgatacttttgtaatatgaatttaaaagtatagaattttaaacttcatgtttaaccatttatttttcagtatcttatctcatttggatatgacccagactttttatgaatatccattgcctaatttaatataactttaatattttaaattacataaaaatttcatttataaagtttctctgatttgtatttacctaacgtatttatttttaacaacacctggattacttataaaaactgggatattagacaaggatagtcatcatttctaattatcttcttgttacagcctgtcaagatcaggtgtttatcacccaagtatgaatcttaaggttaaatgtattggtattttgctgataattaagaagatagaggtgtttacattaagccagcaatatttaattagtcgttttgttaatccatttcacgttataaaggaatacctaaggctggataacttataaataaaagaggtttattttgctcacagttctgcagtctgtagacgtgtgacactagcatctgcttctggtaaagcctcaggaggcttacaatcatggaagaagaggaagggaaatcatggcagaagagaaaggggaagcatgcctgtcacataggtaagatgtgggtgggagaggtctcagactcttttcaagaaacagatctcatggtaactcattacctcaggaatgacaccaagccgttcatgaaggttccatcctcatgacccaagcacctctcaccaggccccacccccaacactggaaaatcacatttcaccatgagaattggagggacagatatccaaattatatcagtcttacttatcaaggagttacataaaggatgatcgttttgcttttaagctgcttatataattttatgcccttaaaccattttagagacaaatataaaactgtctggccattaaacccaggctaaaaaatatatgctaacaattctaaagattatttttattttaccagcaaatttaaagccaccttatttattaaagatttactcaaagcatgtgaactaaaaggcatttggataaattagtaaatattttaacagtcttaagtattaaattatatgagttctcatttattaaaaccaatcttaatagaatttattaaggtatttctgaccaattatgctagattttaccctgtagacacaacatactacgtgtgtaaacacacatgaacacatatgtacacacaaagatatagctttcattttagaattttagacatgagacattaatatgttctgatctgtaatcttatcatggctgtaaaccaaattttgggtaaagcagttttcatagaaatttttttctaaaaaatgcatattttactccatttccccttttttttcattttcagttgagttaggggttaattccttgtcgccttgtatcattggaatgccattagaaaaacaatctatgagtgagattttccttgtttttatttaaatttgtaactacaaagactgttgaagcattcagtttttattttaatacaagcaaaagaaaaatcagcagattcagagtaggcagaagaaaaacaatacatagagaacttgaaagcctgtacatgtaaatcttatagatgcagtttccttatagagttcaaataatggccattgagctctgaatatatatatatatatatatatagagagagagagagagagagagagagagagagagagagtgtgtgagtgagtcagcatcttacttgtcacccaggctggagtgaagtagcataatcatggctcactgcagccttgacctcctgggctcagggaatcctccttcagcatgctgagtaactggggctacaggcccataccaccatgcctggctaatttttgaattttttgtagagacggggttttgtcatattgcccaggctggtcttgaactcctgggctcaagcaatccacccacctcagcttcccatagtgctggggttaaatgtgtgagccactgctcctggccaagctctgattttttttgtgtaatttcctcatcagtttaaaaatgtgtacaagaatgtgctataatatagccctcctagaatccctgaaagaaggttgttctggaatgccattagaacttgaagatcccattccatttcttattaatctttcagagcaaagaaaatcattttccctgctgtatgaaatttaaagtgtatacttaccagaaattcaaaatgtctctaatagaaaggacttgtgttaaaaatgcaaaaagtcttttgtcttcataagagaaatgcgggttccttatgaaggtggatttatctaagtcagatctcaaataaagtcagcaggaaacatctgccaaaaatagggcatcttggcctgagaggagactcaccagacactaaaggtgaggtgtggaaggggagagcagagggctcaggtgactgctgcacactgttcttaagaattactgcttttttccaaaggtaatcttgctccacttctgactctagatatgtcaacctaaataaaagacgaagagagagtctccgaagacactgagtttattcaggagtgtgcaagggatttgcacttccaggatatgcagcctataggattcatagacctatccaaagagattgaggaacgggcaaacttttaaagacaaaaggaaaaagaacatgtaatttgttttgaaacaaagagaatattggtgacaagggcttatctcaggagtccataccagttcattatggagacagtgttaatcaagtgttcttatgcatccagctagctatcctgtaactcatgtagcaagctcaagtttgaaaagtcattggcaaaagtttttgttacagacatttgtaattgttctgatcataagcatgagtgtgtgagggtcctcgcttcttaacctcccatctttatctatgttttgttggggtttgatgcaagcaatccattttgagtttgataacttttacaatatcaagcaaattctaagcaaaacaaaactgatgtagttgtattaatattatgtaaaatagaatttagggcggggcgcggtggctcacgccttgtaatccaagcactttgggaggccgaggcaggtggatcacgaggtcaggagatcgagaccatcctggcttacacggtgaaaccccgtctctactaaaaatacaaaaaattagccaggcaaggtggcgggcgcctgtagtcccagctacgtgggaggctgaggcaggagaatggtatgaacccgggaggcggagcttgcagtgagccgagatcgcgccactccactccagcctaggtgacagagcgagactgtgtctcgaaaaaaaaatagaatttaaaacagaaagcaaagatagaaaatcttcactgctaacaggttgtctttatcacaacggtataataaattataatttataattatctaacagcatagcgtcattgtatttttaaaaatggcaaaattttaacataactttctcagtaaatgataggtcaagcatataaaaatcatttaaaaattgtacaatataatgaatcaccttgatttataaggtatatggaaccctgatcaaaaagggaacaaaaatgtatgtacacatacaacatttatgaagattaactatatatgacaccgaaaagcaagtttctgaatgttttaaagaatcagtttcagacagaccgcattctgttactgtaatgcagaaagtttcaaactgaaattaaaaaattgaacctgaaatgccaggaatgaacaaattttaaaatgtaagcactatctaatatgacaaagaggtaattgaggtagaaattagaaaatacttggagttgaataatactggaaatgttacttaccaaaacttctgaagtatggaaaaagcactacttagagaaaaatctatagtcttaactattcatatttaaaacaaatacaaaagctgaacattaatgagctatgtatctcatgtaagcaatttaagaactacaaaaaaaccaaaataaagtacaaagaagaaataatgaagtgagtaacaaaaatttttaaaaaattaaatagtgggggtaaacaaataccacaatcagtttttttaaaaatactaataaatgagagagactggctagattattaaatagatgaaagagaaggtatacataatcaatgataggtttgaaaaggtagacgtagtaaaatagtatgcattttcttgattcttgtaaaataaaaatatagatatttagtaaaataatgtgtttacaaatttactacatttcaacggggccaagcagtctattagtcacagtaggtacagggcctagggctcaggatatttttagggacgcatgaaaggatttaattttactttttaaattgtaaaaaaaatgaatatagtcataatgaatatctaataatgaatccaggcaggattaaatttgtttctatacccacatagtcataaaatattatttttctatatctattgctgaatttatgtatttattttttaatatatgtttagggaagaaggagctaacaaaggcaaaagtgctttggacccactaaagtcatgatacagccctgaattcaatagcatacaataataaattttaaaatacttcaagttatattaagtacaatatatataatatgattttataataattatgcctcctaaaatactttgcaactacatgtttaaattatgttttctaaagatagaaaaatattaaacagtattttattaaagtcctcttaagaatcagtttttaatttttattgcaaaatagtcagcaataaacatatatgttatatagttgtaaatataagacttgatattaacattattggaatgacataattgttttggaaaaactaagcaatatcatcttcgattataaaatttaacaatgagatataaaagcaatgtgagagtggtatgcagaagctgcctggagccaatttgtaggagcctattgtgtgcaactcttcccaactctgcgttcagtgtcatcaccttggtattttgaagtaggccatgatgagagtgtttgcaacacagaaatctgcaaaccctgcaaatgaggacccctcccccactgtttggacagctgactgttaaacatttactaccacactactgtatggagtatacgatacataaaagtagtgtctataatgctcctatataaaataattagggggtgataaggagattatctttgaataacttctactcgtctttacaggatatatttcattttctttaagtttctaagttggatctgcaatatctttagaatttgtaaccagaactactttttaattccccttagaagatttcaaatgttttcaggcaatattagtttactatcataatactaaattaaaaccaaagcaggtatggcctttaaaattcaaggggatactttgtggaagggaggttgcgaaacaagcagtgtagactggcagaaacaaaaattatataccttccctaaaagccaaataagatattgggttttataacagtgtcttatttgatactttacagtgttagtggatgctgcctttaataaggaaaatataaatatatttggaacagtacattttgtttttcaatacaaggtcttttggtagctgcaaacactgatgattagcattttgttcgaaattgtatggatgaaactgaaaatggaagagttgtcactgtaaattttttgagctgatagaaatttctgatggaattttttactttggaaattttcaaaaatactaagaagcaaataataatttgtatttccacactcataatttaatgctattaatttcttggcatagttgcttgtagttttataccttttttgttaagaaaaatcactattgttgctgaaaaatattacacatgtgtattgaaaatattcaaacaaaaaagtttagaaaagaaagaaaaaatagaccatgaatattctatctggaaagttttatccataacattctagaaacacctttgcaggtgttttatctgtacataaatacagaaaaatgagggttcaaagaaaggaaacttcacacattcagtccctgagttcctagaactccattcatgcaatttaatcaagaacctattcccagaactccattcatgcaatttaatcaagaacctagaattggatgccaaggcgcataggaatgaccctatatgcttatatttccaacctcaatgaacaaactcttctttctctagatgacatttccaatcctccaaatctaagcccctcaagcagccccaacttgttcgttcctctgtcagtataaagattatccttgaatgcatacccttacttaaacaatcctcacactttccccctcatctcctgaattttctccagcctgccttgcagagtaaatattttactaataataatttgtactacatggtatatctccatgccccctgaaactggtattgacctgaatcaaaatactccaaaatattaaacccttctcagctagtttggttacttatcattcatcatttttataacacacacactcatatacatacacttactttgttaaaaataaagagaacttaaaaacaatggcatacataatctgtaagttgtcagataaagcatttgttttcttttcctatgtcagttgttgtttctggaaggtggaagagggaattaggaataattatactttattatatatgttgctcagtggccaaatcaacataggttcattttaaacatcagctgttctggtaatcatcatacttagaggtaatagtaatttggctcaaatactttatttttgggcatattgcttaagcatctgtccatgaattagcttttgtaatgtttcaatatgttctggttcatgttgggtatatttgattctgttacagtaagttaataccatagattttcaaagtagtccttggataatgtttaatatgtttccttagacaggcagcaatttaaatcattttttgtgactcttaatctacttttcatcttattcaaatttgatactagcaatgaacttgcaaatcgctttctcagatttcacagactacattaggttagatttgaaagaaaaataggtgaattgtcacagtaaagaaaatatttattacttattcatatagatataaaatttatttttcaaactcaagttattgtattattgttgatttacatatgaattccagagtagcatctgcatatgagccatttcctaatgcagaaatcatcaatagagaggttatactgttgattagcctcttgaatatcctcagcacatatgtatttctatctcctaatatttaacatggtttttgcctccatataacctccatattttatgatttgatgatagaaatataattaggcacataaatgaggtaatttttacaaaatattttttagtgagataaaatttgcaaaacttgaaaatcaaccattttaaacagcccggtgtcactttgtgtattcacaaagatgggcacccaccgcttccatctagtttcaaaacattacagcaccacaaaataaaaccctttacccactaagcagttgctccccattctcctctcccctgccagatccctggcagtcaccaacctgaagtgggtctttgtatttacctattctgagtatttcacataaatagaattacacagtatgtgaccttttgtgtttggcttctttcacttatctttacgtttttgaagtttattcagattatgtcatgtattagtatttctttttttttgagacatagtctcacgttgttgctaagactggagtgcagtggtaagacctcagctcattgcaacctctgcctcctgggttctagctattcttttgcctcagcctcccgagtaactgagattacaggcacacacaaccgcgcctggctaattttttgtatttttaatagagacagggtttcaccaagttggccaggctggtcttgaactgctgacctcaagtgatgcgctcccctgagcctcccaaagtgttgggattcaggcatgagctactgcaccccacctcattgtattttcataccacaatttatttgtcacttcatcccttgattgatatttgggctgtttctaccttttggcaattgtgaatagtgctgctaagaacacgagtgtatttgtttgataacctgtttttacttcttttgggtatactcctaggagtggaattgccagttaatatggttgttctatttttaactttttgaggaaccaccaaaatgttttccacagtttgaaatgaaccatgttggctgaggcgggcagatcacaaggtcaggaattcgagaccaggctggccaacatagtgaaaccccagctctactaaaaaaatacaaaaattagctgggcatggtggtgtgcacctgtaattccagctacttgggaggcggaggcaggagaattgcttgaacccgggaggcggaggttacagtgagccaagatcgcaccactgcactccagcctgggcaacagagcaagactctgtctcaaaaaaaaaaaaaagaaagaaaaaaaaagaaatgaaccattttatagtatttccaccagcgatgtatgcgagtttcagtttcttcacatttttgccatcacttatttttgatttttaaaattatacagctattctcatgggtgtgagggcgtatctcattttggttatccctaataactaataatgttgaacatcttttcatatgcttcttggccatttgtatatcttttttggagaaacgtctattcaagttctttgcccatttcttagttggactgatgatttgttgttgttgcattgtaagggttttttatataacctagatgctagatccctatcagataaatgatttgcaagtattttctcccgttctatagattgtcttttcattttctttaaaatattatttaatgcacaaaagttttaaattttgatgaagttcaatttatactttttttcttttgttgcttgcgcttttggtgtcatgtctaagaattcattgccaaatccaacatcataaagatttatctctttgttttcttctaacagatttgctttagctcttataattaggtatttgatcaactttgaggtaatttttctatgtggtgtgagtccaacttcattctatttttgcaatagtatttggttggtgcaaaagtaattgcggttttggtattacttttatggcaaaaactgcaattatttttgcaccaatctaatatatccagttgtcccagtccaatttttttgaagagtctattctttcctaattgaatagtcttggccttcatgtctaaaatcaattggctatagatgtatgagtttatctctcatttttattccattactctcatttttattccatttctatttaataccattttatttttatatcattttcattccattactctatatgtttttctttacaaatatttcaaagctaaataacttaggaattgggcattatccacaatgtttttaaatgattaatctggaattttaaattaagatataattatgtagataatatgttgtaggcactgtgctatgtagagcaaacatagacttgaatatgatactgtctttactctcaaggaagagcttaatgtttagtgcgggtccaactttagtaaaccaacaatttaagttcagtctgataaatgctcagattgagtacgggatgttataggagtgtaggggatgtaacaggtgtactcaccaatgtctattctactccaagtaattagtctgaagtaatcatgaatcctattctccttgccagacatgatgttttcaaggataggtatgcctaagtcaatttaagccatgagagtccccaggagaggttactgaggagttctggatatggttttattgctcttaagagaaagtataggaagcttctctcttcccagtgaaaataaatgaggaaatgttttccaaagtggtaattgttgcatgaagccatattggagactgcagagcagagagtcaagactgaactgtcttctgatggcatcactgaatcattagttgaaccaactcggaattcagaaccatctgtagtcttccttttctgtgagctcatcatttccttaactctttattatagtttaaacatggaattctgtttcctgaagataaaaagtcctgtaaggaacacagtactagaagtacatctaaatcggattgaggaatacttaaatggcttctcggagaagatggtatttgagttgaatgttgacttttgaattaaatgttaaagaacaagtagtagttagctaataagaagcagcatgattttaaaatattttctctcaacttataggttcccttttcattttgtttcctgtactgtgcaaaagacttttagtctgatacaatcccacatgtttatttttgcttgcattgcctgtatatggtgtcatatccaaaatatctttaccaagaccagtgtcgaggagctgtttccctttgtttaattatcagaattttatggtttcaattctcatacaacttagtagaaaaaaaatttaaaaatggacaaaagacttgaataggcattttcccaaagaaaacatacagaaggacaatagatatatgaaaaggtgctcaacattaccaagcatcagggaaatgaaaattaaaaccacaatgagatattatcttacatctgataggatgcctgttatcaaaaaataaaaagtacaagtgttggtgatgatgtgaagaaaagggaaactttaagcactgttagtgagagtgtcaacaggtacagctattatagaaaacaatacggacattcctcaaaaaattagaaataaaaataccatatgatccaacaaatctacttctgggtatatattcaaagaaattgaaataagtctctccaagagacatctgcactcccattacagcattattcataatagtcaaaatatgcaaacaacccatttgtccattgatagatggataaagaaataagatttatgtatatttaaatatttaaatatatatttacaaatttagtatttatatatgtatattatatccatattgaatagatatttaatagatatcatatatctatatttaagatatatatttaatagatatatatttaatagatatgtattgtacatctatatttaatagatatataatatatgtattatacacacacacacacacacacacacacacacacacacacacacacacattggaattttttcagccttaaaaaaggagatcctgtcttttgcaacaacctggatgaatgtagagtacattacactaagtgaaataagccagacaccaaagaaaaatattgcaggatcttacttatatgtggaaagtaaaaaggcctaatcatagaagaaagtaggactatgcttaccaggggtggggaggggggtgtgtacgggaaatggggagatgttggtcaaatggtacaacgtttcatatactagaatgactatattctagagatctaatgtgcagcatggggagtatagttactaatattgtatactcgaaacttactaaggtgaggctagatcctaaatattcccaccacatcaaaaattagtaactatatgaagggatagatttattaattagcttgactgtagttcactatgtatatgtatatcaaaatatattgtataccttaaacatacataaattttataaaaataaattgacaataattaaataaatagagagcacaaatggtagttaaaaagagccttaagatattacacatgctaacaaagattttacagtataaataggataatagaatatagaaatagaaagacaatgtatgctatcatatgtaatatgttttctaggtttcacatcaatcctcttaggaagataattgagtataagggaatagatgggagagacactttgaaatgctgtaactcaacagtaacataattatataagcacataattgttgaggccagatgtgttgataccacaccttgaggagttttcaaagcatcaaagttataataaagagatgatgatatggtctagttaattactgcctatagtagcatattaaatctgtaaactacagtgctgctaccaaatctaagatactgataccttctgatattatcgagatcacattttgaaaggaagagaatgcctagagaccattttcaatggttttctaggactgagctgtgaatagcggtaatctgaaaaacaatggcaagtcgagtctatattccaacccatatttaaggggaaataagatttggcactttggaaattcatctatcaagaatatatatcaatatatagttgtactcatcactgtgttcatactctgctgaccaaaatttaaatgctagctaaaaaggattctgggaagtatgggttttagttatgcatccttgtacctgtctaaaattcaggatgttttattactaaaaagaagaagggaagaattaattctggaaaacaattaactgtggaattatatagatcccagcagtaagttatttagtctaggaactaggtggaagcaaggagaccatataggcaagtaatccagtgatctagatgtgaagtaataaataatgctaccagacttatgaggttggcactgaaaaggattgggtggatccaataaatgttgcaaggaaagaagcactataacttcatgactggaaaacagaaagaaataaataaaaatcaatgcttgattatttttatatgatcttcagggaaataatcaagttggttataaataagaactcctgttatattaacagtaataatagggataagaaagaggatggttctttttaaaaatacctggtttatagttttaaagaatctattttgtaaaggacaagaactgtctttctcttacaaatttcactcaaatatgtagatgattttgattatcttgacaagcaacctaattttacatgttgtgatatacttgatattctgtaagaggtctaaagaactgataatgtaaagggaaaatgcattcggtgaatgaatatgctgcattatttatttgttattcatcatactgggaaattgtagcaggtagagactggtgagattatcacacacaaacacacaattttttggtaagccacaatacatgaataatgttatactaactttaaaaaatgagtcaatattataaatacaaattctagggcctcacattaactttttattttattttattttattttattttattttattttattttttgagacagagtctcactctgtcgcccaggctggtgtgcagtggtgcgatcctagctcactacaacctccgcctcccggatttaaatgattctcatgcctcagtctcccaagtagctgggattacaggcatgcactgccacacccgggtaatttttgtattttgttttgttttgttttaagtagtagagacagggttttaccatgttggccaggctggcctcgaactcctcacctcaagtgatcctcccgcctcggccacccaaagtgctgggattacaggcgtgagccactacacctggcctaaagttaatattttaagcgacaatcttcttgcccattattcactgcaaaaatgcatacatctctaatgggataaccacttctatcttgaaataaagatgtgtaagtcttggttctgtctatgctaatgtaagtatttttatcactgtaagtttgtacatttgattgtttgggacttgtcttggacagtttcttactgtgtgtttgaatttggtctatagatttacactataaggaaacaagtttattattttcttctataagaatttatagttatttcaaagttatgagttgaaatgttttgatagaagactacataaccatgggttctgattcaaaaataagtccaatcagtaatactcatagttacttgctatgagttgttaattaacttgttgttaattgtttgcaagatagataaaattagtaatggtttatcattattgactcccaaaccatcctgtttggatatgtgacatgtgcattttaagagttacagatactgaaagcaagatctaatatagaatttttaaaacacttttagctatctaccaagtcctttggtcatagattatttctaagaataataaaacattgatatcctaaagtatttgacaccagtgatttcttggaaagtgagcaatttgatatttccattgatagacatattagcatggctatatttgctagtagttgtaggtaaattcctttattataaaataaatttacctttattatcattattatgttttataccctcaagtggattgccagtactatcacagggaaaagagggttcttgggtctgagaattttgaaattttgtttcctcttaagaataaaaaataagtgttatatgtaacatcttgataaggaaatattaatgataccgagctctgaaaattaaaattagcgtctgtggaaaaagtaagccaaactagttttattcactaaaacacctaaaatcaactttttgatatatacaatctaccgtggttattatgcacttttatatctttgccaaattatccttacaattttccgactcactgtaatgaaacatattttccacttcatgctataccgtggcatttcattagtgtctataatggtacttgaattcaatcagccatattaagaactgacctatttacaggatggttcaaacaatggtgatacatacatttagatattgatagttttaaattctggtaaaaggtaacgttttatgactgatgaaattaatactggaacaatgagtttaattgaccaccagacagtatgcaaataaaatgtcaaaaattcatataatttaatagtccattaagcctaatggagttatatcccatataagccaaaggattcaagtagaattctattttggataatcatctgttactatttgaatataatttagaaaaatgcttagttctttactgtttgaatgtaacttagaaaaatgcttaatctaaaatatttaaaatatttatatgattttttactggataaaaataaacatgctcaagagtttaaaaatagatgcattttatcacttctaaagaggttataagtctacaatgcaaatattgtcagtgtctagatgtgccggcaagatggcctctgatctgccaccacctgatagtgtagttcccagaaaaccttgagttatcaaaagctgtgttataaaaattgcatatccatgagaacaaaagggccttagggcctagagagtttgaaaaaaaattacaaaaaaaaattatagtttcctgtagaaattttaataaatgctctcttagattctctaaaagatgttataaatctaaatgtgaaaacaaaatatttattaacatattttcatgaccttggagtaggcaaagttttctaaatgagacttttcaaatcattaatcataaaagaataaaactaataacctggaccatattaaagtaagaacttatcttcgtcaaagtacattattaaattagtgaaaaaacaagcaatggagtgagagaaggtattttcaatacataaatctcatattcagaatacataaagaacgttttacaaatcaatgaaaaaagatagagacaacagagtgggaaaagtggtaaaaaaaaaaaaaaaattgaacagaacttcatcataggtatccagacacccaataggcatatgtaaaggatctcaacttccttagttatttgagaaatgcaaaataaaactacaatgagataccattacacatctatcaaatggctaaaatgaaaaagacaatacaagatttgaaaaagatgtgtagcagttgaacctcttattcactactgtagagtgtaaattggtacaactctttttgataattatttggcagtatatattaaagctgagtatatggataccctgtaactgagaaatttgactcttagctacatacccaatagtaatgcaaacataagtttgccaaaaccaccatacaagtatgctcataatagcattaccaataatagccacaacctggtattactcaaaatgcccgtcagtagtatcatttttaaaaacaaaagatagtaatggtatgttctcacaatcagacactgtacaggaaaaaaatcagtgagtgaaccactacatgtaagtataacaaggtagatggatttcaaagaaataatgtctacatatacacaaagctagaaacataagaataaatacttaggattgggtttatttacagttcaataaaagacaaaactaatcagtatgttatgtcaggtgagcgcttccccatgtgaggagtggtcttcactgggaagaatatgaggagggcttttggagtactgctaatataggatttcttattctagatcatagttacacagatatgttcaattttcgaaaattagttgagatacttacgatttctcatcatttctgtattttctacttcagtaaaatttaaattgtgttccgtgcaggtaggcaaccatcaaaagggacccagttcacaacaaggagataaaccttggtagcctctttatcccttggttccgacactcttctccctcacttagagacgtagaggcagctggcaatagcaatagggggatcccaccacatccctatctcacagagagacatcctgcagccagccctggaaaatcccttccattcttcccaggtaacaccagtatgtaccagtgggagctgcagaggcaccaaatgtactgtaagaccaacataagatcgcaaaggctatgaaatttaaaccatcattggaaccacagcccaccatagttatgtcaagacctacgtgttatgtgctaacaaagagaatgcctactaaataaaagatttaaatagaactcagagtctcctatgtgagaaacatgtttcctcaaaaattgcttgtagaaatataaagtgatttcatcttttataggaaatagtttggctatacctcaaggtattaaacataggttaccatatggcccagaaatttaactagatacttactcaagagaaatgaaaacataagcctcaaaaacttacatatgaatgtacatagcaatattattcacagtaaacaaaaagtggaaacagctcaaatgtctagcaactgattaatgaataatcaaatcatagcatatccatacagtggaatattatttgctaataaaaaggaatgacgtacagtcatatgccacataacaaaatttcatcatcagactgcatacacagcaatggtcccaagagatcaggagttataggaactgaaacaggacgataaaaaaagaagaacccccaagtaaattcatagtaaacaggtcagaagaagctgttgcagacctcaagaagctccttaaaaagtttgaaaacatggacctcaatacctagtggtcttaactaacagagaagaatgtccatggtgtattatctgcttaaaagcaaatctatgatgaaaattaactgaccatatcaccgtggacacatttctgaaaagggtgacaattcctcaagaatagccccacacaagtcctttaggaagcattccagaaaaaggcatgcttgtctaggagatgacagcttcatgaatgttattgctcctgaagacattccggtgtaataagatgtggaggtggaagacagtgatactacttaacctgaagggtaatatatgcatctgtcttagtttttttaaaaaaactttaaaaagtaaaaccaaagttaaaattttaaaaatgtgaaagtaaatcaaagcttatagagtaaagacctaaagaaaatatttttgtatagcagtatgtatgttttaacctgcgttattatggaagtcagaaaattaaaaaaattacaaagcttataaagtaaaataattaaaaagtaagctaaagtcaatttattactattattattattattattattattattattattattttgagatggaatctcgctctgtcacccaggctggagtgcagtggtgcaatcttggctcactgcaacctccgcctcccgagttcaagcaattcccctgcctcagcctcccaagtagctgggattccaggcatgcaccaccacacccagctagtttttgttttgttagtagagacagagtttcaccgtgttggtcaggatggtctcgaactcctgacctcgtgatctgcctgccttggcctcccaaagggctaagattacaggcatgagccaccgcgcccggctattaacttcttattaaagacagaaaaatatgtttataaatgtagtgtgacctacttatactatacagtttttataaagtcttttataaagtctactatacagtttttataaagtagtatacattaatgtcctaggcttccacattcactcactactcactcactgacaccaagaacaacttccagtcctgcaaacttcattcatgataaatgccctatataggtatgacattttaaatcttttatcctgtatttttactgtaccttttctatatttagatatgtttagatatatagacacttaccgtagtattacaattgcctacagtcttcagtacagtaacatgctgtacagtttgtaacctaggagcaataagctgtgctatatagcctaatatactccatgatgttctcacaatgacaaaattgtctaatgatgtatttctcaaaatgtatccccgtcattgagtatcacatggctatattaatatgtatagtaagcttgaaccttgcatgcattattctaagtgaaagaagccagacacaaaaggccacttattgtacagaatgtccaaataggcaaatccagaggcaaaaagtagttagtggtttcagacactttgagagtagggaatgagtagtgactgctaatgggtatggagtatcttttaaggaaaaccaaaacattatggaattagatattggtggtaattgcacaactgtatagaaaaactaaaaaccgctctttggacatgaacatggcgaattttatggtatgtataaaacttattttaaataaagaatcaaatgaagattataaaactgaaagattcagtaagagaaataaaaataatttgctggattagccagtagtaaagtagagatgacagagaattgaatcactgaaattgcggataaaacaatagtattcactctgcagataaaatagagtgaaagattatgaacatagcatcagttcttacatgataggaactaaagagccaacattaataccatctgagtcacaggagtggagaagagggtggggctgaaagaatatttgaggaaataaaggctgaaaactatcccaatttggcaaaatacagaaacctacaggtccaagaagacaattgaacaccaaagaggttaaatgctaagaaatccccaccaaaatacatcataattaagtttttgaaaaatataatcagagaagaaaatcttaaaagcaaccagaaacaacacactacatattgacaccaatttgaatgtcagcaaatttctctttttaaactatggagtctgtaaagaagtggcataatttccaagtgctataagaaaagaacttcaaactgtgaattctgtgtttagagaaactatccttcatgaatgaaagggaaacaaaaacactgtcagatgaatgcaaactaaaatcatttatctgctacagaccttcctttaaaattgtgtaacagaagttcttcaaatggaaaggaaatgacaaaggaaagtaatttaaagtataacctacataccattggctatcctcttcctcatgaaatttgtaaatcttttatgattgaaacaaaaagtataatcctatctgatactcagtgcaatgatatttaaaagttgagaaggtaaaggtaaaaattggacatgtggtttcacacttcattctaagtggaaaatgctgatactggtgaactactttaattcatatatgtatgtagcagtacacagagcaaccactatggaaactacacagggagatacattcaacactataaataaatcaaaatagattcctaaagtatgttaaagtagtccaaaggaaggcaaaagaagagagagggataaaatgatgaaaatgaggggtttttttttcaatttttttgattatactttaagttctgagatacatgtgcagaacgtgctgtttgttacataggtatatacatgtgccatggtggtttgttgcgcccatcaaccgtcatctaggttttaagctccacatgcattaggtatttgtcctaatgctctccctcccctggccccctacaccccgacctgcccagtgtgtgatgtgttcttattcaactcgaacatcccgtgtttggttttcttttcctgtgtttgctgttaatgatggtttccagcttcatccatgtccctgccaaggacatgaactcattcatttggctgcatagtattccatggcatatatgtgccacattttctttatccagtctatcactgatgggcatttgggttggttccaagtctttgctattgtgaatagcgctgcaataaacatatatgtgcatgtgtctttatagtagaatgatttataatcctttgggaatatacccagtaatgggattgctgggtcaaatggtatttctggttctagatcattgaggaattgccatactgtcttccacaatggttgaacctaatttacactcccaccaacagtgtaaaagcattccagtttctccacatccttgccagcctctgttgtttcctgactttttagtgatcgccattcaaactggcatgagatggtacctcattgtagttttgatttgcatttctctaatgatgagtgatgatgaagtttttttcatacgtttgttggccgcataaatgtgttcttttgagaagtgtctgttcatatcctttacccactttttgatggggttgtatttttcttgtaaatttgtttaagttccttgtagattctggatattagctttttgtcagatggatagattgcaaaaattttcttccattctgtaggttgcctgttcgctgatgataatttcttttgctgtgcagaagctctttagtttaattagatcccatttgtcaattttggcttttgttgcaattgcctttggtgttttaatcatgaagtctttgcccatgcctatgtcctgaatggtattgcctaggttttcttctagagtttttatggttttaagttttacatttaagcctttaatccatcttgagttaatttttgtataaggtgtaaggaaggggtccagtttcagttttctgcatatggctagccagttttcccagcaccatttattaaatagggaatcctttccccattgcttttaaaggtaggaacaaaatgcagttgcttacaaccaccagtgttattttgccctgatctggaagatgagccaatgcaagcagataagaagcatatttattagtaatacaatcatatctattgaagaaacagcaaaacaataatataattcattattgcagatagttgtaacattatattaaagcttttaaaattctttgcctatggaataattatagcttcctttctaagtctgatttcaacttgatcatataatcaattgatgcttctctatactcttccaggctggaatataataggagctaccatttacttgtttgataggctctacctctgtcatgctttcacagaagaggcttttactataaagaagtcacacattgccctagttaaactgtccagttaagttcctgaaatattgttacagtgccaaaaccaatcatctttgtagatatggttcttagtatttgagaaaacaaatcaggttgtttaagagggagaccttcctagatagaaaaactagactccacagatagaggattgtgtgcacctatgtgatattactactctactaaattctatattatttcatttaactatttacataattttctcataaaacattagctagcaacatgcttatttaaaccttttatgttaaaatttttgtaattttgcactgtaagatgagctaatgcaaatagataagaaatgtatttattagatattcagtcgtatctattgaagggacagaaaaacaaggtaattcattattgtagataattataaaattattttatataaaatattttaatattctttgcccatgtaataatcatagacttatttctcaatctgatttcatcgtgattattataatcatttcatgagctctctatagaatatttgaaaagtatgtgattgattacttaaacaagtaaactataatgtaagctggcactattataaaataaacacgcagagcaatagagttattactatatatgtgaacctagagattttagtattataatgttactaatattttaaattacatcgtacagcataataacaaaagttttcagactcaatggtgttagcaagggtagcacatacaaggccaaaatataaaatcaagggtatttccatatattcacaatgaacaataagaaattgaaatcaaaagaatgcaattcctaaaacttcctaacataggaaacacttacatatgaatttaacaaagtgttctgaaaactacacaacactgatgaaagaaatcaaagaataccgaactaatgaagaaatagacattttttgaattagaagaattaatgttgtcagtcttcctcaaattgatcaatagattcaacatactcctaataaaaattctagtgcttttttttttctttttttttgagatggagttttgctcttgtggcccaggctagagtgcaatggagcaatcttggctcactgcaacctctgcctcccgggttcaagcaattctcctgcctaagcctccctagtagttggggttacaggtgcccaccaacatgccaggctaattatttgtatttttagtagagacagggtttcaccatattggccaggcttgtctcgaactcctgacctcaggtgatccgcccgccttggcctcccaaagtgctgggattacaggcctgaaccactgcgcctggccaattctaatgtatttttatgaattagtaggctgataaaatttatatggaaatgcaaaggaactaaaatagcctgagcaattttgagaaagaatgaagttggaggattggtaacacttgatttcgaggcttattctaaagcagtggctctcaacagaggactcttttgcaccctcaggaaacatttggcaatgtctggggacattttgcttctcataacttcgaggtttctactggcagctagtggatagaggctagggaatctgataaacatttgcaatgcaaagtatggcactcagacaaattatccagcccaaaatgttaatattggcaaggttgaaaaaacctgatctaagctccagtaatcaagaaagtgcaacattcattaaagagtagatccatatatcaataaaacataaatatacccacatatatatgatcaactgattttcaaccaagatgcaaaggtgtttcaatggagaatagataaacccttcaacaaatagtgctggaacaattgggtataaatatgcaaaaaataataataactttgacctcatacttcacattcatatacaaaaattaactcaaaattgattataaacctaaacgtaaagctgaaaatcataaaatacctaaacaaaacacaggagaaaatctttgtgacctggaccaggaaaagactttctaggtatgatatcaaaaccatgatccatgtaagaacatattgataaattagaattacaaagtaataatgaataaataagccacagacagggataaaaatttgtagagcacatatctgacaaagaacttgaatctaaaatatataaaggattctcaaaactcaagaaaacaaaaatgatgcagtttttaaaaagggcaaaagatttgagtagacactttaacaaagaagatatatggatgaccaataagaatatgatgatactcaatatcattagtcttagacaaatacaaattaagaatgcagtatgacaccactgctgcacctacttctactactactactacacacacacatgcacacccccaaacaaacaaacaaaaaccccttaaaataccagatgagaacacagaacttctgcaattcctgtgccttgctgttgggaatacaaaatggtacagtcactttgaaaaaacaggcagtttttaagtatagttaagcatatacataccaatgacataatctcatttctccatctttaccccaaagaagcaagaacttaggtgcacacaaaagctgtatgtgaacgtttgtagtggctttattcataaacaccaaaacctgggaacaatctaatattcatcacctggtgaatatataaacaaagtgtagtatgtttacacaatggaatgctacctggtactaaaaggaactaaactactgatacaacagcgtggatgaatctcaaatgcattatgccaaacaaaagaagcaaaatttcaaaaactaagatcttatttgattccccagcagcctgaaccaatcacattgagcttgttttgtgttacagaaaaacatttttttactctttaatctgtgtgttcttggaggcctctgttacaatggccaaccttaccttaactacgcacagtgtgtaccaaacactgctgcactctcacatttagttctcacgacaatattgtatgtaggcattttaaactcatttttacagaagaggagaatgagtctcaaagagatagagtaacttgctcaaggtcgcatagcccaaacattttggattcagatctattccaaagtctgtatacttttgccatatatagggttgtaagtcagacagacctgggttcaaatcctcatttagccatttactcctcttaagatttgctagacgttaaagataaatttggatgtggctatttcacagtgctgtgagaatttaagtaataaaaggatatacaatttggttcaaagtaaacactaaataaatgctgactgttattatgcctcaatgcctctcctcatctgtatacatacttgggattttgcagtaattataaaactacatataaagtgcttagaagcaatatatctgggatgttgttagctttaattattattcttgtatttgttatacatgcttaattggggaaacttctttgattccagtaagttcattctcaaaatgtgctttgcattctatctaaaatttctcgtgaaatagttacattcctgaaccagtcacttgcaagatagaaaggcgtatatcacttctgacattcattcccagttgagtttggagcatatacagtcagagatgttatcaagataccaagattttgcttcattactcaacactaatggacaagctgaagtagtttatttttcgaagagactctgaagcacacttaaggttttcattgtttactatgctattctgtgttcaacaatagaagggtatatatcaagcttgtccagttcattcacttacatgatattttataatataaatgggaaactgtatgggatacttctgtttaagcccataactcattttttttaaaaaaagtattctcttcatctaaatacattgtttcttgaaaaaaaattttccaaaaagtaatgcagtgaaaattgttctttcttccttgttcctcctctacactgttcctattccattctcaatgggagatatatatatatttgtatatatataatatagatttatatatctatataatatatttatatatctatataatagagatttatatatatataaatataaaaaaatatatatccctctggatatttctccttttttgaatgcatataaaagcactacagaattttccaagaattttgtcatttaaccaaactgaactcttggcacaccatttagatgaaaagatgtgtttgttccatgtggatccctagtatgtctgctaacaggattgacaataacagacattagaaacatactctgaatgtttactagttttacttaatctgtttgtctctggcagtgattcagaatggagttagtctggagctgttattgaacttcattgttactgttcttgaagccccactcatttcctgccaccccatccctattgtgtttgaagtagaaagctaaagtgttgtaagatggtgaagaggaacacagacatgttttagtccttggcatctcaaggcaaaattggtacttgaaaccagatatcaacctttagatcccatattctttcacctatacattgctctagtccatttcatcctctttggtatgtttttacaaaattttaaaatttacacacacacacacacacacacacacacacacaaacatatatgcccatttaagctgagggaatactagaagttatggatgatctgtataaaggagatgatctttattgaaagagccttaaaattatactgattttttaaaacaaagaataactttattctaatattcgtttaaaactgtacattgatattattttataataatggctgctatagtgtgaacatttacgtccataaggtctgctttggaccctttattagataatttagtaatactaattataataaccaaaggaatgtatttacttctcatggaccagtttaatgtggatgttcgcaccagtaagatgttttcctccatatagtgtgttaaagacccctgttctttccattttatggctgcttcattttctagactctacagctagcagaatgttaaagagacagtggagaaggcatctggttcttaaaaactatggccttgaactggtgcataaccacatctgctgcatttcagcaacaggaaatagtaatcatgtggtcatacctgcttggaagaggactgagatatgtggtctttttcttttctttttttcttttttttttttatgataaccattgttaatattttattaaaagccctcccatacttttccctatggactaatacatatatatattcatgtatgtgtattaggcagggcataatactatacatactattatctaatctgctttatttttcactaaatagcatgtatgaattttttttattatactttaagttctagggtacatgtgcacaacatgcaggtttgtcacatatgtatacatttgccatgttggtgtgctgcacccattaactcgtcatttacattaggtatatctcctaatgctagccctcccccctccccccctccccccaccccacaacaggccctggtgtgtgatgttccccaccctgtgtccaagtgttctcattgttcaattcccacctatgagtgagaacatgcagtgtttggttttctgtccttgcgatagtttgctcagaatgatgatttcagcttcatccatgtccctacaaaggacatgaactcatcctttttatggctgcgtagtattccatggtgtatatgtgccacattttcttaatccagtctatcactggtggacatttgggttggttccaagtctttgctattgtgaatagtgccacagtaaacatatgtgtgcatgtgtctttatagcagcatgatttgtaatcctttgggtatatacccagtaatgggatggctggatcaaatggtatttctagttctagatccttgaggaattgccacactgtcttccacaatggttaaactagtttacagtcccaccaacagtgtaaaagcgttcctatttctctacatcctctccggcacctgttgtttcctgactttttgatgatcgccattctaactggtgtgagatggtatctcattgtggttttgatttgcatttctcttatggccagcgatgatgagcattttttcatgtgtctgttggctgcctaaatgtcttcttttgagaagtgtctgttcatatcctttgcccactttttgatggggttgtttgattttttcttgtaaatttgtttaagttttttgtagattcttcatattagccctttgtcagatgagtagattgtaaaaattttctcccgttctgtaggttgcctgttcactctgataatagtttcttttgctctgcagaagttctttaattagatcccatttgtcaattttggcttttgttgccattgcttttggtgttttagtcatgaagtccttgcccaggcctatgtcctgaagggtattgcctaggttttcttctaggatttttatggttttaggtctaacatttaagtctttaatccatcttgaattaattttagtataagctgtaaggaagggatccagtttcagctctctacatatggctagccagttttcccagcaccatttattaaatagggaattttttccccatttcttgtttttgtcaggtttgtcaaagatcagatggttgtagatgttcaggatacaaaatcaatgtgcaaaaatcacaagcattcctatacaccagtagcagacagagagccaaatcgtgagtgaactcccgttcacaattgcttcaaagagaataaaatacctaggaatccaacttacaagggatgtgaaggacctcttcaaggagaactacataccactgctcagtgaaataaaagaggacacaaacaaatgaaggaagattccatgctcatggatagaaagaatcaataccatgaaaatggccatactgcccaaagtaatttatagattcagtgccatccccatcaagctaccaatgactgtcttcacagaattggaaaaaactactttaaagttcacatgaaaccaaaaaagagcccacattgccaagacaatcctaagccaaaagaacaaagctggaggcatcatgccacctgacttcaaactgtactacaaggctacagtaaccaaaacagcgtggtactggtaccaaaacagagatatagaccaacgaaatggaacagagccctcagagatatgtagtccttttctaggcagttacttcctatcattaactcctccccaaggaatgggaaccgttgataaatagctattcatctgtgcacaaactctatttaaggtagtttattacttttggtattgtttcattatgtggccctgaaatttaatatgttggtgggttttgtgaaatttttattttaattcactgaagtggcaaaataaccaccacactttgttgtgtgccattttgtggtagaacatttgtgtgtgaattctcattgcaatgcagagtatttcttgagtgagaatcaggtctgtgttcacctctagcctctgtaactctctaggtgtgaggccttggagaatcacttaatttctctgagcctgtctttcttcatccataaatcaaggaggttagataatgtgttataatcttcaaaggtccttacaatgttaaaattatatgatatttgagtgacataaattttaaaagtttatagtgacgctttgttttatttatttgtcgctttaattattgtgcttaagaaatacgttatcattttgagttaacagtcctcactaaaagattaaaaatttgctatttgtatttattcaggcctagttaaatttaacagcaacatgaaataaatgattacctgttttagatataatttcataataaggcctctgaaggtcgtttgaaatactgcactaattaacgttttatttccagccttccttaattattctagccagatggtcctttatttatgttattgctagaggtttccagctgaggttgtttgattgttgaagaaaaatatgtgatggcaccataagataattgtaattgaattgttaggtatgttagagcatttgagccttctgtcccggttctatccacatctgggaaataagtttgttaacaaagcactttgacacctcatctgatgcttgagtgagattctgaactgtccagatggaattcaaatggggaaatgactgtgcattttattgtaaaaggcactttgcaaatatctgtgcaaaattcattttgtgaatgaaaagaaaaaaacctttaaaataaagtacacttttaagggcatgatctgttttccaagtgtcataataacttcaggaataaactgttgcattaaggtcaaatttaaaatttgtgcagattaaccaccatttaggaagcagttaagtggagtttttatggcatggaacttcaaaagtgtaaatgaattatcagctgaatagatagtccaataaaagaagcagacttaaagtggaagataaaagtgataaagtgacagtaaattagagaatagaactaaaagctctattgttatgaagaacaacaatagacctgaattatctatgtttctttacaaagtatcttttctcatttctgtgcttatgagttttacaattactaaataaatagtattggatctgaaagcttgtatcagccaagttaggtagaaagccttattaacatggccactggcaacttaatactgggcaattttcctccaagcaaacgtgatttcattattatagtacttaagctgtgcacatgcaggataaatcagttcaatgaccttcttcccaatatgttcaaagatgttgaaatctcagcgtatgcagagctgacacgattggacatgattgttcaacatcttggtaattgagatgctgttttttcaaatcatggaggcattgtttatcttatattgtttatctgatttatatataaataaaattttattggtcagaagactttcataagtcaagttactggttgagtataaggcactaatataattattaatgattatggaggtatcaaatctggatgataatttgatacctaatgaaatggtaaagcaaaacaaataagtaacttccagtggaacgcacacacacatgcacacagatacgtttgaatagaaaagctgaccatgttgatttaaaaagattttcaaagaaactagagaggaaggggattggatctgttgttttgtcttctttttttaaatttcttctatcactttgctttcttttgcccataaaaattaaatggcatacttaagtcacccatcttagaggcactgacttctgctaaataagagaaagagcttatggagtgttgtgttgttcatttttttgtgttttttatgttttattttttccttattgacttgtcccaaagccatttctgtgttttggttcgttgattattcccacttgaataatctctctctgcaggaggctttttgtaccgatcactaaagtaagtctcctaatttataactctgaatatattttaatttgcccattgtggaatatgtgctatctaagaatatctacatgtgcttcaatacatatacttagttctaggcagaatgagagtcaatttgaatgttccgctgacttgctttggaaacacacataactacaagcccttattcagctattggccacgacttagtttataaggggagatcaatgttcctagactctgcatgaattaaaagaaagtgtatgtttgaaaatgtgatccagtctttttattcatgctactagacgtggagtgagagaagagaacaagggctacctattgggtactatgctcactacctgggtgatgggatcattcgtaccctaaacttcagcgtcccgcattagacctatgtaacaaaagcttgcacatatgccccttaaatctaaaataaaagtcgaaattattttaaaaagaaatactaatatcaaaaagaggaaattagtcattactactattgggtttcacttgtaactgacaagtcatttccttttactgctttcaagattttctccttttctttctttggctttcagcaatttaatcacgatgtatctatatgtggatctctatgcatttatcctacttcatgtttgtttagcttcctggatgtgtaggttaacgtttttcaatgaatttgggaatttaaagaaaatgaaaatgtgagcaaggcattcgtgaaactaatacagcttacgagaaattagagagggggatctttacataaccatcttgctagaagttattaaatgtgtttctattgggattaataagaagatgcaatgatacctttggttagtttgctttaattatgtatttcgaagttggctttttctttaccgatgattggttagtgatgaattcatcatccttctatatggcaacagtaaataaatatgatatagagaatttgtaattggccaactaaaagatacttgtagaaaatatatgttagaatgaactgtttagttaactattataataatgaaaacaactgtagtaaccctgtttaaaggatttatgaaatagattataagatttctttgttctatacattaaatgaccattttgttcacaaatttgttatggattgtagtaaatttatgctgcaaagtagactcctaaataattgttagtaaagatttatgcagttttaattttttatataattttacatattttcatagctgtaaaggggattgttagcatttctctatccaaacatacctgccagaaatcagtcattgttgttgttgttattttttttttccattatactgacacagtctaaggaaagttagagggttttctattttgtatttttctcattatgtttgagatgacaaaatcattcatcattctcaattactggaaggcaattcactgaattcaatgtgagttaaaagccagatacctataaaattcttgcactgaccagtaataataagttgtgatgcacattttatccctaacatattaataatatacctattttctattgaattatttctgagatatgccaaaccagtgcaagtgaacattaacggatggcttaaagaatggagaacatatttacgataactagaagaaatggacatattaataacctttactattaatagctagtaaaatgtctttgatcttttttgagggcagcaccttaaagaagcagtatatattcgaggtctcatatactgtaaaagcatcagaatgagtgcataccattctgcatacagtttacttttaagagaacattatatattattaatcctaaaagccattagacaagagaacatttgctgtttatttaaattttacttggataaaaagaatttttctgaggttatcttatgttttaactaaatatttgtcatttattatagatgaattattaagagatttataatgcatgtagattttccttcaatttagtaaaaaggaaagtttattactaatttatgtattgtaagttatgtagtttctagttaaaaactagaactgaagcttttgatttatttttaaataatagtttttatttgtcattgcgtaaaataattacaactcttaaactgtaaactaaatcaataggtaatctaataaatgtaacaattgaaaagacacatttggctggtaagtaaaacccttcagatttatgacattaaatgtaaaggctttcacatgcttttatttttaagctctgatgtgtcacttttcaaaagtgttatattggctgtttacaaatatgcttttatatatgtagctatgcacatgtaagttttcatctgaaattgtcatgtacatttattttggtcatgagtgcctctttgtggctttcagtatgaaatccatactcattagcatctagtacaaggcactaagtgatgtgatcacagtaatctccttaggcctatctctcaatgtgacttcttgccccagattttctcttcaccctaactggctttgctctgaacccaccatggtttttgttttctagatctgtttgcaaactttgcctttccgtttggaatgtttgctaagtcctctgttacccaaaactggcccctattttcaaacaacagtaacaatatccttctgatggacctttagcactctggttatcattgttttctggaaggtcttccattgcatattaaccctcagtccaggctaagtattttctctgtgttctctagcagcctgtgtttacctctgtgatggtcatgctgttatggaatttcctgtttattcatttctctccccaacactctaagctccttgtttgcaaatattgtgtcttatttatctttttatctccaaaacaatcctgcacagtgccctggctcatagcagacacaaaataaatgtttgtttcattagtgtttatcaaacaaaatcactcatgagtttcacctacaaatgcaatcttaaatgtgcctgtgatcacatccttttttatgtgtaacttctggaatcaacaatgtaccatgaatactgatattaaatatgattatctcaggtatctcctgtgagatagtgaaataacccaccatatttgtctctaaaactatgttttatcctcagaactaaatacaatataagcagtctgaaatatatattgaaatctatgcagtctgaaatattcattattgacatttcctgaaaacatggaagtgttttccagttatttgtttgagagactggcattgctgttgtagacagaatggaaatctgtgaatttcttttcttttttttttttgtttttgagatggagtctggctctgtcacccaggctggagtgcagtggcgcgatcttggctcactgcaacctctgcctctcgggttcaagcgattctcctgcctcagcctcccaagtagctgggattaaggcacccgccaccacacctggctattttttgtatttttagtagagacggggttttgccatgttgaccaggctggtctccaactcctgacctcaggtgatccgcccgcctcagcctcccaaagtgcagggattacaggcatgagcaactatcattcccatcattcttcttttctcattgactaatttaaaatgttacctgggaaactgtttaactgttaatggttgccttttacattttttgagtaaaaattgtaattcctttaagtaagacactgtgttttatatagctcctttactgtgcatgttgttggtgtccatgtttagatgagtaatgaaaattattgatgggaaatagggtcatttttattattgctgcagacaagatgtggtggatttaagatgaccacaaattctttgacattactcacaaagaaaggtgacatttatgtcccctccccttgaatctggatggactctaagaaggctttgtccagttgtgtacagtggaaatgatgctgtgccagtttcttagccaagaccttaagagactgacaatttccacttcttgtctcttagagcacttgctcttagaatgtttgttctgggtaggccagctaccatgtattgaagtctgtcttccctgagtgaggaggagtgaaagagggaaaagaggagggagagagaaagatggagagagaccaaggaacaccaggataccagataagtgaatgaagaatgtgaatccatcttggaagtggatttcccagtcctaatttcctcagcggccacaacatgagtcagagatgagctacctatccaagttcttccaagattcctgactcacagtcatgatttaactatgggtatcgttggttaagccattgataaccggaaaaaaagggcgatcactttatacaaataaggaaatttaacatagtttagtctctaatttgtgaatagtacatataaagagtggattgtgaattatatcttgagcgtccttggtaataggcatatgttgccaaaatttctttcatattccttattaattaagtattaaggttattttttcttcatagatcgacatgaacaaagtttgaaggaccctaaggaataaaattttagtaaataaagtagaatgcaagatgatcatctcattctgtgataactacttcttttgaattttgtaacagtttctgtgatatgcatgttgattttttaggcttacttttaccttttgggcaagcccagtcctctgaggtggcagcaagaacaacaagccactacaaatagctagtaatccaagtcaatttcagtttttccatatattaatgaataaaacttaaaataaaacttaaaattaattcaaatgtgaattaatgaaagttctgtttatttatcctaccaatgatcatgtcagatcatgtcagtaggagaagcaaggatactttgagctgttagggtcaatatattttctttaatttataactaagatctttgccctgtaattttatcctttgtctactgcaaaaatttcctccccaaactcctacttgcaccgtgcactaaataggaaaataagcctgaccatatgtgctgctgcccctaaatactctttatttgcacatgagttttctctttattatgttattaacataaatcaggatcccatgaccaggacaactgagattagcacctctactctttggtattagccaggccttctgctatgcttaattgatctccaacagtattattggcccgtttcactgttgtgcttccatgaatgtaactgattctgaattacatgtcattaaaacaaatactttgtaatgtcccctttattagcaagaaatgaaactcatcaccagcatgacttatatatatagctccttaaatcacttcttttcattcaatgttgttttgatataatattaaagagaaaaaaatacttcctggatgaagccagtatctttatagagtttgcacattctccccatatctttatagagtttgcacattctccccatatctgtatgggattctctggctactccagtttattcccacatccaaaagatgtgcatgttaggttcattggcctgtctaaatgatcccaatctgagtaagtatgggtgtgtgtgtgagtgcgccctgcaaagggatagcatcctgtccagggtgggtacctgcgttgctgccccaaggtggataggttctggccacccaccaccctgaactggaataagttggttcgaatatgaatgaatgaatgaatgaataaaatgattgtaaaataaaatttcatgaagtttactatagtcatgcaagtgtatggcagtaaatgatgtggtaggagagtgttcactgacccccaagttgtgattgtttgtttttgaactgagtggtggtaggaggttctccttataattttctcttcacaaacatttattccttgatacatcctaccaccactatgattactgtcactcactgactcaccaaaaattgggtaaatcattatcttacttgttttaattactccttcttaaatatatatatagctcacatttgtttcaatgtttaatattagaagtgtttgaggtctttagttagaagcgatgatgttacataattagaaatataccagaggaaattaactcttgtttatatcaattagcctgcagtaaagttggtttcattatacatcatttcactgaaactcagtttccaaggacatatcaataatgttaggtgaggacttaatatacatgattttaaaaaaatacagtaaaatgtcctaatgtaaaagatacataaaatgaaggtaatttataataaatcaatatatatttaatagctaaatgtttatgtgactgtgctacaaacataacgatgtagttagatgcttgcatctattcatagaattagcagaaatagatggctacagatgctgacaaatagatgcttgttgttttggtgactcatccaccatgggcagcattgcagtacagtgacattttttgaaaggataaatggctcacaataaatttagaaacaaagtgaagggaagtcttctcttaaaatgcacatggcatggcagttgcattcttgaaaaattcagtgttaataactgtgcaaaatgtacttagtatttacataaaaatatagttagggattggatttagataattataaatgggtgagtacttggttagacatttgaatgtcatgcaggagtcacgatggttcacagtggggaaagtatcttgggcattgcaggatctttagaattcccggcccattaaatgccagcccagctgtttccccattcattgtcataacggccacactgacacacacccaagaaatttccattacatccctttgggatgtcacttccaccaattaagaatctttgctttaaacactctcccttttcttctttatcttttctgtttctacccctgtatctttctgacagtacatgtttcctgaattctctggattaatacataaaatgtatcctaactaaacatatcacaaaatgttatcaaacttatgtaataacataattgtaactctttatgaattctcttaccaaatatattctcataaatcttggcatataaatgttaaactataccctatttttaatagtataccttttaactaatattactcatcatattgtataattctcaatttatactgttagtaatttttttcctttttttttttttttttttttttgagatggagtctcgctctgtcgcccaggctggagtgcagtggcgcaatttcggctcactgcaagctctgcctcctggtttcacgccattctcctgcctcagtctcctgagtagctaggactacaggcacctgccaccatgcctggctaattttttgtatttttagtagagacggggaatttttttccttttatatctatatatgagtctactcatttgtaataatacaaaaccccttaaaggaaagagcacatttttgtatttaggggtctcttacccaaaatagatggatatatgtatataatatttattatatttgttgaatgaatgaaaaatagactattctattagtatccttcttctgtggataattatgagtcttggaggtttcaaccttttttagtgataggaataatttgataaacttttaagcaatttgtttcaaattagcagcattctccactgaaggagggagagttccagggggtatagtatcctccctatctggtcaggaggatatcagttcaggcaccagcttggagtgtaaagcacactagtgaggtaaaggtatttattccctctgcctcttccctgtagagttgcctcaagctggctgtgtcctttgctgtaaggtcagagtttttctcaaggtagccatctgtatcagtccattctcatattgctaataaagacatacttgagactgggtaatttataaaggaacaagtttaattgaaacacagttcagcatggctgtggcggcctcgggaaacttacagtcatggcagaaggggaagaaaacacattcttcttcatatggtggcagcaaggagaagaatgagagctgggccatgggggaagccccttataaaaccataagctctcataagaatgtactcactatcaggagaataacatgggggaaactgccccatgatttaattgtgatgggtgtctcccatcacacatagggattatgggaactacagttcaagatgagatttgggtggggacacagccaaaacatatcaccatctctacacaacattctcctctggcttctaataaccttccctccttttctctttttggcttgtggagggtcctacacaacccaatatagtttccctgcactctgcccacacctttgtaaataatccttttgtgaaccttcctcaaattatcctaatttgaatgtgtcatctctttcctcttaggcactgactgatataacccccaggcacagttaattatctgcttggtgtttccatgacattgtgcatatagctcctttattcatttctttattacataattcagcatatatttattgtgcatccactaagtgtcaggcagtctcctgggcccacaaggaaaatatatccatgtaagttatgccagcattagttaggcagttgtatgctatttaatgttatttaatgtaatgttatttacattacattatttaatgtattgtaatacagttatttatgcagttattgtaatgcagttatttaatgtaatgagtcctacacatacagaagtctatagtgctatggaacttcataaaaaaggttcataacttacacataatcattggagacattgtctcaaagaatgtgaaatccaagctgagaccagaaaagtgagtaagaattagacccgcagagagggctgacagtgagaagggaatgttccagctcaagaaaaacatacttacaaaaccaaaaaaggaagacatggcatatttgagtaatgaaaggtaacagatgatgtgtttatgacgagtgagggtgtgtcaagagatcgttctggagaatatgggtcagattataaaggacattgtaaactgtgctaagaagtttacctttattctaatgaggatccactgaagcaagaagcatgacatgaacaggttgtaactttggaaatgttattctgattagttgtagagcataggtaagaggagaataagaatggagggagggagactgtatgtatggtcatgatagggggacgaaccaatgtatattcacctggtggggaagaagaagagtaatcagatttcagagagattttacagatagcacctacaagacagagtaatttactggtatttgggggtctgaatccctaattctaaagacggtgggagatttcaagcctaaacctccaagtttatgaccaggcaactagttggcttgtagtgatagtcaacgaaatagagaaggtgaactgtgagcaagttttggaggaaaaaccatgaaggcagcaatagataaatctaagtggaggtgtgtagtaattatatagataagtgggcttgagttttatgagacagatgaggattggtagtatggttttagaagtcatcaacataagctgaccattaaagcaaaggagataagatgaagcagtgggggcagtaagtcagaatatgattgtatcatattctaaggcaaggatattttaagaacgcttcaggatgacacctaagtaaggactgagaagggctcagagaaagaaatgaacagggtgacaaaccttgattgagacagtttccatgataaggtggggaagaaagcctagattagagaagtaagagatgagaaagtagagtgagtaaaaataactctttcaagtatttttttccctgaaagagaagagaaaggattttagttttggtaaatatggtggtggctcaggggcatcgattgcatgcatgcatgcatttacatatgtaagtacacatatgaatatgtaggattctatgtatgttaatgggagtatcttaaagtggtttaaatgctgatggagacaggcactagggagtggattaaaggtatagggaaatgaaataatcattagattcagatttaggggaaggtaggataggaacaatatcattattatcaatgtatattgttctttcttactagcttgatccctaaaaaggcaaagactatattttttttgtatcctcagcatctaagacattacctagagaatactgggatcttctatattttagttttaggaaaaaggaataatagcttgctaaaataaaatagttaatttacctcagaactcttccaagatcctcagccaacatttgcattatatcctaccttcaaaaactgtcaaacgtatgtcctttaggtattttatgcatagaaatgttttttaaatgatcccttttggacattaaataacagttttaataattttgaattagtactaagtgccatttaagtgttctcctgatatatactaaatgaaaacagaaaatgatgcatgggagaaatgagttagatcaatatggttaaatttaataaaattcaaattaaagaatctacattatttctatggtgatatcactatgatatgtgataataactccctcaatgtataagttccagtcagaagatgattatgtgcagaaagcttttgcttttgtgaccctatatctcacctgttcttttttattgattgattatatttgaagagactcaaatctgtttacattagattaggctatataccagccacgtgattttctgtcatactaaaatttcaaacttaagatcagaagtaatctagattctataataaaaaatcatgacatatgctatggagcttggctgtgactcaattaaaattgcattttttttattatactttaagttttagagtacatgtgcacaacgtgcaggttagttacatatgtatacctgtgccaggttggtgtgctgcacccattacctcgttatttaacacgaggtatatctcctaatgctatccctcccccctcccccctcctcccaccccacaacaggccccagtgtgcgatgttccccttcctgtgtccatgtgtcctcattgttcaattcccacctatgagtgagaacatgcagtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatatgtgtgcatgtgtctttatagataccatctcacaccagttcgaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagcaatcccattactggttatatacccaaaattaaattttatctaattatgttggtggtagtcagatgtgtactctttgaccagttacctgtagccaatttgtcacactttctttctgaaacttattgaatagtttttaaaagatattttatcttttgagaatttttggtaaaatgcttagttggcaataacatctgatttatgaatttatatgatatccctcataatagaatttcaaaatacattttaaaaattactttttaatgatagaaggcaaattccacctatctgatcattccaaaggcagaattattaatttgatggcaaattgattttcatatattataaaaaatgatgctccaaatagaaaagttttacttaaaatcataataattttgccattgatcttatacaaactttaaaatccatatgttcaaagtacttaagggaaaaaggaagtagttgatatatccttgacatctgctgctaaaaattagattactttgtattcgcatttaaagtaaacaatgttaaacatggaaactatcaagtgaagaaatatgtactgttatctcttctgaagagttattcaaatttttattgttatataaattaaaatttagtgtaattttaaaaactcgttttctctttgtaactggttagtatatgccaaggcctgtgttaagtgctcaatatacattatattatttaatttatgcaatactatgaattattattatttccacttatccagtgagtaaactgaggttcaaagaatttagataacttgatatgctcacaggctagtaactaggcaaaacatggattcaaatttgggtttctgtgacttgaaagctcatacactagacccttactatgtatattataatttcagccatttgcaacatttttactatactttaaatgtaatatttgtgcatacataatataataggctatatttgtttatatatcttaaatgcattaaaagaatatgtggtacctgttactgtgcttagaacagctgtaggaattatgatttacaagcatgtataatatgctatctacctttcattctgcttggaaaaggatgacatatatgagtaaaatagtgagtgatatcatccaaattgtatgatatacattatcatataatagtataatatacgaaaagtgtgtgttagaggcagcaaatcctataggagttttgttaaaaatgagttcaatgtagtcatatgtcatcaagtagaactttttgggggagatgaggactaaacatggatggatgccaaaaaatcgcattggcttgtgtacacacaaactggacctgctgagatccatctgctttaggattaaggttcctctaaaactgaagagcgtcatgaattttctggttctgaaaatacttttagcacagtggccccatgaatctctatgccctgtgactgctttatattactccgatgtagccaaagaagtttacttggaattctagcacctgcctttgctcattggcaaatcccactgcttgacccataccattttcccacagctcccactttacctgagttttgtcctggacggtctgtcccaccatgctctcacctaaatccagccttcctacaatagcatccttccttgattcctgttctcattgagactaccttcctggcccctttgccagtgttctccgctaaagagatgttccccacagcttctgtggctggcttctccagaactttctaactccctataccaatctgtaggaagcctcacagtcagtattatgctgtgttctccatggctgagtcagatattcagaacgtgtgttttaaaagtagtaacagcttcaccatagcaaaagcatagcaaagaaaggcagtaaatcctgacacaattatgaatctcaaatgtattctttcttgctgtgctattagatatgagcaataatagtttataaggatatatgtaggcttttgataatttctatttttaatttgctatgaataatatatatgtgaaaagaaaatatttgtgttcaagatgagtcagtattttgcttattaaatatatgtcctatcacggtgtataaataagcataccactttgaaacaattaaatgttttgcaataaaataaaattcagatataaaatagttacacatttttcaaattagtctatttttatcaaggtttataatcactttccagtacatgaaaattatcatataaataatttaatagaagactctgctctcttcacatttcaaagtttattttttaggtatagaaaaaaatcaatattttttttctcattttcactcctagaattagaatccaaatcatttttaggtatttcttttaatgcttacttttaaatttacctaactgtaattttatccagcggtgaaaatctacaggatcagggtcaccttgccctgtgtcaagctattccacttcttaactgtctctgtacttaaaaatctatgtcatttgatattaaattctgagtttgtgtttatttaattttaaagccaaagataaaatagttcaacacaggaacattatcccagaaatgttgttactacctggtcatttggccactgaaactgaagaccagatgggaaaacatctaatggtttctcattaatacagagaatgtagttcaatagaagaggcaatatgtttgttgttgtggccagcattaaaataaaagtaatcaagaaggtaaagactactgatgtaggttgggagacaggagttggggagagggatttagtcactatgtttaatagaaatatataacagagtcattgattattaaactatgaagatatttaaagatcactaatacaaactcctcactttcctagaaaaaattgaggcacaaagaaggtaagtggcttaacccagtataatccaaaaaattaataattaaccaagactaggatatcatctcgtgactttcagtcagtactcttttggcctttgaaaaaatacagacctgcgtaagtatttatatgcaccaatatttggagaaaatatataaggaggaagacgagagggaagaagaggcagatgacgaggaggaagaagaagaaatccatgaaaaagctactgagaatcagtgaatacttctaataaaaaatggacaccaatttaaatctgttgctatctggaaattctctttcttcaccacatatatttaagaattactaaataaatgttagaaatcaagcaaaaacataacttgtgactccccttgagtcacagtttgaccactgttgctcatccagggcaacctgtgaagagtcattatctagaaagattcgcctgaataaggcagacattggaccaaagcagcctcaccctatgactaggactcgatttcagtaagttgtgtttcctgtatatttttgttcagaaagtggtacctgttcctcactggtctatcagactcattaaatgttaaggattcttaaatgggttgtaactttgaggcatcttctcttttgcagttttggttttgtttctttgcttaggtttcagggtgaaaagttgatgaaaataacattggtatggtaatttgattatgataaatataaataaaggttagatgttctaagacatagttaaattcaaaggacacctgtaagaaagtggaaagatagctgtaaaaagtttcactgacaaaaatatagattctttctcaagcctcatattcagaaattctgatgtaggaatatacaattttaaaagaaacttccagagtattttaaaggtcgtccaaggtttgaaaaacactgacttacactgtctaaatattggctgttatgattaactgataaagtttatattcaattcattgtgtatcatgttttgactagtttattgttgcttttatgtgtttgtttatgcttttactctgtgtttggattattcatagcttccttaacacccattaccgtagtttattgagagttggctcggttgctttggaaagctatatttctgcaattctacaactccatacttttgtaattaaaatagagttcagacttattatttggaactacctttaggggtaactggcaaaacacataaagaaattagcctcactgctatagctatgcctcatattttttccccaaaaagatatctagatctgagccttccaatatgacagccactggcaacatatggctatttaaagttagttaaaattaaatacaatttaaaatctagttccccagtcataccagcatcatatcaaatcctcagtaggcacagtaaatacttggtatttaacctctcaatattaaacagcataaatataaagcaaaaagttctattggacagcactcatctagaatgaccacctaccctattcacaagactagtctgtagaacttttaattatttgcaatacttaaatccacttttaaagggtaaaagaatttgccaacactaaagatagtcaaataattttgccataggatctaagggaggggacagtgctcgtattttgagcaatatctcaaatacatgcagtttagggactgtggatgactatagatgaatagcacagcttttatatgaatatgtacattttggtagtgtaccaggtatattctgcctgcccctccaggtccactcttcactgctgtctaccctgctctctgccccagaagctgactgtagttactatgccaatggacttccttacactttgtcttccagtaggtttggtatggagtatgagatcaggatattgtctcccactcccttctaaaaaggtctcaaaggctgactgcactgcacaacccaaggtatatcagttatctattgtggtgtaacgaactatctcaaaatttaatgacttaaaacaacaataatgtattcattctcacaatttgatgggttttctgcgttaataagtaatctaagaagttcctcttttccatgttttgttggcttatgcgattacattgaacagggaggtctgcttaagtcagaacctgtctggcatctcagttggagtagctagaacagctcagggtggctgatcttttctctatatattacagttgaatgacactacatcattgctcaggggttcaagaggaggaaagtacaagtttctagacctctgaaagtctaggcctggaactggtccagcattacatccacaacattacatctactgcatcttttttttttttcctcctttgagatagggtcttgctctgtcacccaggctggagtgcagtggtgtgatcatgactcagtgcagcctgaaactcccgggggctcaagtgatcctcctaccttagcctccccagtagctgggactacaggtgtgggctaccatgaccagctaattttttaattactatttttttagtagaggtgtggtctcactatgttgcccaggcttgtctcaaatccctgggctcaagcaatcagcctgcctctgcctcccaaagtgctgggattacaggtgtgagccaccacacctggaccatcactgcattttatcagccaaagcaagtcatgaatcaacttagtttcaaaggatggagatgagacttgatgggagaagcagcatgcacctacaaatacaggagggattgctggtagccatatccaccattgaaaatcacagattctgtctagggacctttctccatgactttcttgcttttgatttcttggtaaccacttgttccccttacccctccaagcttaggggtggtgtgactccccggttcttacgaatccctacacactgaattacaccttgtgaatttcctatgcctgtttaccccagtggggtaacttcaaaatacctgaatggagaattattttcctgcttgatcctgtttcatctattctcaaaaattagttatgttgctttatcttactaccttatacctgaaattgttcacaatattctattaatttttttgtagcaatcataaagcatttaaaattttcctttacccagttagctttacatttagtctttatgatttcttacattaggatttaatcttgatggagaatgaatattaagtttaactaacatatctgtaagccattatttcaaaatgaaatcttctgattttggtaacatctgcaacctccagtgaccagacctacagtctttaactgtatgactcagttctgtgttctgtgttcagtatcaatgtcagtagtgtactaaaatgtccattttttctctaggattacataaatcttttacatttgtgtcttaaacaggtcaccaagcatttaactttaacctttttatatcatttatgttcaatagaattcactacttttactactctcatcagtgcttgtcttctgacttattaataaattaatgagcttgttttaacaattgaaatttaaaccagatggtcatatgattactcagtgttttcaggatcgaggattttaaaaactaaatgtcattattcccctcagacatactgatttcttgatattaaattattttaaggtttatagaactagatccagaaaaaaatgcttcgtattgtagaaggaagagagctttccatctttaatttacctaaagtggttttccaaatgattatatgtaaatatctgacaccacattgttttcttttataatttatttttgattctgcttaaagaaatacaaggctttagcaaatttaaagtggtccactaccccaagacttaagaaaacatttatactaaacaaatttaacaatgtatatgtcatatcaactgaaaatctgaatttttacttttttgctcatttttctgacagaatatgatagctgtctgaaggatatgtaatatttataaatgggatatagcagatacaacctgttaatatgatatacactagagttagagtatatctagatatagaaatactagatttgtaatattgagaccacattactgtgatatttcattgcagctataataaatttttatgacttatcataaggtaaatgccaactttgcaacatgtatctttttttctttgcaactgacattctatgttcagattcattgtgctcctgatatattcccatcatttcctttcctgggagaatccctttcttgtgaactacagtgacttttttattgacatactgcaagtgcagaagctttccaacaaagcattgctttgtaacagtagaccaggtacattctgctaagcaataaatcatgtatatattcactggagcacaaaaatattttggtgatataccaggtaaaaattgatattctagtagggagattttgattaaatgccctttcttctacaactttggtcaaatttcaggtgtttaattcccatatatgatgatgtttgtgaacttcaatatacattgttatgtttttcacctgaattcccagctgaatgtaaaaactgagaacaagaaaaggtgttattacttagaggtgtttttaacagctctccaatttcataacttgtcatttcccttttctttgatttagaaatgtgttatactcctggaagttttcacatttgatagatgtaaaaaatagaatactttgagagggattatactagcatagtggttaagagctcagactctggagccagagaactgggttttacatttcatctgtttcttacttgcttttaacactgtacatgttaatgtctcaatgcctcagtttcttcatctttaaaatggaaataatatccatatacatagggatagtcatactttatacagttatggtgaggattaagagttaatatatgtgtagtgcttaaaaagtggctgtcatataataaattctatgtgtttgctatcattgttgctattgaaagacaatgaaagcacatttgctcatttaattagttccagtcattgttattaatgtatttcatttcatttttcctgcagtgaaaaagaatgcaatggatccttttgccattatttaacattttaagttgcatttttaagtttatatataatgtattctacaatatttcacaatatatgagatattgggactttaataataacttgtgtgagtaatgtctctagtcttaaagactctaacactatcttaaccaggcaaagtaaaacactgtcttaactactgagcaagtagtctctttgaaatcagcccattttgtggatgccatatacatgttacactttaaagcatataaggttgatactttactctttctcaacattgattagagactaagaccttgttttgactataaaatatatttctttaagagggagaaggagacagtgccctgtgtttcagtgaggtatggaacacctgagttcaggtcaaggtcactgccatttacttgctatgttgatctcttacctttgtgactcacagtttctttatcagctaattctgtgattagtataaaaatcaaatatgagaaataatgtcgaaacactttagatgctgaaaatattacagaaataaaaagcagtgttattgaagccactgtacctttatcctgctgaagaggttaaggattaaattggttttgaatatatattctgtggtagtggggttggagcattgcagaacatgctgatgcacatgcttagggagagggacaatgatttctagccaagtgtcagaaggactgtgtggtcgtgaaacacaggctgcatttggcagaagtgatccaagctagaggtcagatcagtggtgtccaaaagatgatttagaagtcttctttttgcccaaagccttttgatgaatttcctatcaagtatttttctaagaactgttaataaatgtcaaaattaacagatttcagttgtatctccttttcatcctgactctgcaagatagactccagaatatagcctaaaggaaagagaagaaaagaaaaagtaatggatagagtagatgcttctaatataaaagatttccaataggctgagtgctatataagaaaaaggaaaaatatttgatatttttaactaacatttattgcgctacacattttgatagcattccaatgatgattcgacctgccttgtctttgagattcttcaactagttgaggaaagacatctatcaaggaaagtatctacatttctcctgaagctatctgaaagagttccactgtttccctaatcaggttgttaggtaaggacaaagatgagagcatgagtaatagaatttgtggggtaggtgagggcagccagaccactgcctcggcagggaacaatttgggcagcctccaaaggaaagggatctttgaggcaagagatttaaagaaggttttttacgaagtttgtttgtaagtaatgtacccttctcttcttatcccaagaaagcgtcactgaacttctgtatttcatttcagtccatttgagttgaagttgtgggtatttagagttatttttggatatgatattatcttgagactgcccataaggtgagagaaacaagatgtcccaataaattttgcatacagatttataaagaaataaacaaaatacagggacactgccactagatttttacataatattcactttaaataacattttaattgtaaatatttttggtcacgacctctaaacaagtcaataattgaaagaaaaacaaataacataattgtatataacacattgtacttttaatgataaaaacaacaattacgactaccatttatatatgcccagccaggaaatattctagatgtctttatatgatctaaccctaacagtaacttgaaacatggtagatgttgatagcctcatttttaatattagaaaaaggaagctcaggggttaagtgacttgccctagattaaacagcctaggaagttgcagagctggaatttcaattgaggttgcctccgaagcctattctttttccaacttattgtattccttttgaaagaacacaacttattttaggaattactcatagaagcatctcctgttaattcgatatttatagtctcataaattgaatcctaaattatagcgttttagaacataatatataaaaaaagtggaaaacatttcgactggtgcaaagaaaatgattaagaggataaaaatagcccaaggcaatagtattaagttaggcaaacgtaagctgaatgttgagaagttaagaatataggcttcttagatttcgattttcaaagtaataacttttcttattacagaaattgttttttatgtatggtgcttattactaaaaaaagattaattatctgtcattcatgtcaccaacttactaagttgttacattggccaatttttgtctttcttaaattattttttatctcatgtttctatctcatttgggggaaagaagaaaaaaggcaaaagaaattcctttctgaatatccatacacattgaagttttatgttcatagtaaactaataactatttcttcagtgtatgacgttatagtattttttcctccaccctcaccacaccttgttttagcaacttagttcattgccaaatcctgccacacctccctttattccactcccatatccaatccagctcatcttttatcgtactgattttaggaatgaatatggtccccttatttaccaaaaggtgtctcagaagttcgtgttgtttcctagtgttcattaaagcttgcagatattgaagtgtcaccagggcattctgatggagatgcccagcaggtgtttgagattgtccctgggaggtcagaatttaggattctatttaagacagtagtttcaaatctgagtgatataatggctctcctttaagagaagtaaaaataagaaatctgcaaaagacattattttattctttttcatggctgtgtagtatttcatggtatatatgtaccacattttcttcttccagtctaccattgataggcaactggccccatgagcatcttgcaaatcccagagtcagaagcaactacagtaagagctggcatgtaagggttgctgaactgcaatatcagacaggcatttgagtctcagtgacagcagcattttctagaaaacagtggtatctccattggtaaagatgattggaatggtgggagagacacttcttatgaaccagtaatttctaagccaagtacagtaatgttaagttcaagaactatatgcaaccaaacactagataatataaaagtaaagcaaattaatataaccaacttcaacatctgtgacagtttgtgttttccagtgatgaccacaatatctcctatcccatatattcttctgtaatgtgactttgctccttccccataaacaggtagtcttattcccctctttttgaatgtggactgaccttaccaactcatttataaccattggaatggaaaagaattcatgtgtgttccttccaaggctagatcagaagacgtgtagcttcttccttagtgtactgttctggaacactgactctctggaaaattcccgctcagcatgcttcctcttgggagctgccatgctgtcagaaccccaggctacataaaaaggctacgagccagcactacacttaatacatccaactgggcccagcctccaagtcatcccaactcaggtgctagacttatgagtgaaggtctttatgtgcaaaggagaaagcaaagagatctttgatgaccagaagaaatatattgccacagagacaataatgcttaccaaatattctatgcacacactcacatttttttaggccccttgcagttatttgaggccaagtaattattcttggagagtgagctatgagtagcatgataaatgtcacttcccaaccataacagagaagatcaggtatgaataaacatgacatttctgatgtcggagctttagatagcctagatccttaagtcactatgtggaagagaaagccctgccaacctctgttagacatcatgtagtgtaagtgaaaaacagacattcttatactactgagattttggagttattttactacctggcctattcttgaataatatactttcttcatttttaaaaaattccattttacttaatcattgatttattacacttactgagttcctactgcatgtcagctacatcctgggaatagaaagatgaataagatgtagtcccagttctcaaggacctccgagtctactgatgaaatttttgtaagtacttaactgtgtatttgcccatttatagactttcttcaaaagagatcttcttggaaaattcaaattatttagcctggaatgcaaagcctttcaaatctgattttacttgtcatacatgtattatttttcacaaattccaaccacaccacatctcacttttctaaaaaaatggactgtatttctagaccactgtgattcttgcatatgctagcaactttgcataaaatgacataaattatctctgttcataaaaattcaacccagcctttataacccagttaaaataccacatctttatgaaatatgtcatgactgtatcaccaaatatgatacatttctctcctaaaaccttagtgatagtgtgttcatttcttttaactctgtctccactagactgtgggttccttgaaaacaagaactacttgcttatttctgctgaacctacacacagtctagaatgcatttaaaatctcatgtttagctgcacatggtggctcatgcctgtaattgtagcagtttaggaggcctaggtgggaggattgcttgaagccaggaattggagacagcctgggaaagatagcaaaacctaatctatacagaaactaaaaagattagcctgtagtcctagctagttgggaggctgagagtggaggatctcatgagcccaggagtttaaggtttcagtgagctatgattgtgcgactgcacactccagctccagcctgggcaacagagcaagaccctgtctcttacaaaagaagaagaagaaggagaagaagaacaagaagtggaagagaaagagaaagaagaaaagaagaagaaaagttcattttctgtcatggggtatattatttatctgcttaagccaaacagacattttaggagcttctgtcttgccttatgttcttgcttgtctagaaatacattgtaatgaagttccttttaacagatatttctctaggcatgctatcttccaaagttcagtgttcattttattcactgcagttatttttattacagcaaataagaacggaaaaatgcaaaaggccataggacttctactcgggtacccactgtggttacatacctggcaagatgttgttaataatggtgtaatagctaacatttatgagtgctactgtgtgccagatagtcttttacatactttacatatattcaatttaattcttataacaaccttattaaatagcttattattatgctcatatcttaaagatgaagcatgaagaaagctcaaaaagctagtgagctagaaaacagtaagtcgagatcgcaggaatccaggccgtctgtctccagagctgtgctggcaatgctctcagcaagaaaggaagttccaagccctttgtagttgttcctaaataacaccgggcaaaattttgcaaatcaatctatctggaaagaaaatctaatagtcgtttcagtgactattaaacaataacaaaaagttaacagtccatataattatagtttcctaaggataattcttattgttagatgaaatttactctagcatatgaaaccatatacagtgacaataagggaaggatgttgtgatgcacaaaactttaatcacaaaaactaaagaaagcaagtttctcagtaatcatggctggagaaaacaaaaagaactttcaaagatattgtacattttactagagatcgaccatagcttaactcattaaagaaaacagttaataatacttctagagaagtacatgtttattcagcaataccttggcataaccatctgcaatacatgtcttatatgcaaaatttagtagaattatttactcagttatctaaataattctaatccacatgcaacttcactttccaaatgagaaaaaatagcagattagttatatataatttggagtgagtgactgagatctctgtctatgtatgtatatctgtattatctacaactgtatctgtatatgtatatatatatatatttatgattcagtaagtatgcagttaagaacacaattctgaactttctaacatctaatgtctaatttatgctgtgtcaaatgtatttttttaaaaaaagataaaaggcaaacataagtcaggggaaaggagcatagagtggagggggaaagaaaaaagagtaacagtggagaaagacggacaggaaaaggataaacaagcagagcaggatggctgattacttacagcatgtgctgaatggagacactcacaggaaacatcatgtcagatatgcttaaatatcgaacttatttctgagtttgtgttttttctgctacacccatgaccaatgtctcagttaaagaaagtagagacaaaagacaaatgcttaaatttcctgatacatacctcttatttacagtacttcttccattgctgtacttgtttttatttctggcagctttatttgcttatttctgagtacccagcataatgtcttacatatagtacacatttggttaatatctgttgaataaatgcattcatgaaagaatgaataaaagaaaacaagtcgatagagggctattgatgtgtgtacatagtctcatgggctaaaagctctaaatgcaaatataaggggttccaggaatttcagggctgctccatgaaaaagatatggccacaggtagaggtagcatacataagctttattttgctaacactttgacaggtttgatacaggaaaatccctcacagcatggaactgtccagaagttactgcatgagagccaccattcagaaggggaggacagcaagtgatatggtttggctgtgcccccacccaaatctcaacttgaattgtctctcccagaattcccacgtgttgtgggagggacccagggggaggtaattgaatcatgggggcttgtctttcccatgctagtctcatgatagtgaacaagtctcacgagatctgatgggtttatcaggggtttctgcttttgcttcttcctcatttttcttttgctgccgccatgtaagaagtgccttttgcctcccgccatgattctgaggcctccctagctatatgggactgtaagtccaattaaacctctttttctttccagtctcggatatgtctttatcagcaacgtgaaaacagactaatagagcaaggaaactcccagaggagggagagaatagggagggggcttacctatctaggtgatgttcctcggcagcaccacattgagtctctgcatcagagagctccaaagggtatcagtggcttggcatatatatagcccaggtgctatctatagcctggggccagcagatatcgggcatagtttcatggggtatgcaaagtaggctgtttgtaactatttaaatatctacttatttagtctatgttgaaaacatagtgaaacgaatgaaaatttgagtttggtatgggtttacttttggactaccaggtctcagcctgctgtgaagaaataaacaatctatggaccaatatacaggagccatctttggctgatttatataacagtaaataagcatgatataaaaaataataattcaacaaagagaggaagtgagtttattggtttttaccaagcattatttcatatactaaatttcttcaggcacatcaagctaaaacattatattaagaaacaggtttacaccactgtacatgtgcaaaaattaaggatcatttctatgatttaactaatataagtacaattgaacaataaataccaatctctataggttaagaaataaactacgaatctttttataaaattgattatgaaatgaactctcccacttttgttattattttaaaaatttatgtggagtagttaaaatgaattaaactccgaagaaaagtaaatcatcattacattttcttttattaccactttgctcattaggaaaactcagttctggcttctgttttgggaaacagtttgtaactgtgtttaatatcatttgaatatctataatcattcttatgcaaatagcatgataataagtattaacattaaagacagaagtttatatttgtcttatattatctgtccccttccaaaaggaacttaaatcttaagtcaaatgctgtaagtgcatgtaggttatttatatcatttctgtcactaaaggtgtcatatgcatatcatagatgccagcaagggagaacaaaccaaaagtcctatccagtcactgcagctggctcaagtttagaaatctggtcatataatgtagtctgcacattatgttctgacttgggtttcttggtcctgagacctaggaactgataaaagaaagtatctcctcactccaaacccaatagacaatggtggaagaggaataagttaaacagtgtaaaccctccattcaaaaatgggaaaaatagcaggcaccattaggcatagtctgcaagcattttggaaatccactgtgcagtagttgtaaaagtgaaggatcctgatgcctgggaggaggtccttctcttactatttcctggaatccctgcatggcatgtactctctggaaggtacttcttttccattatcctctttggccatatctgaagtatgtgtgacggaatatgccttacttgggggcttcagtgaaggcttttcttcctacttcctgcttaaagcaagttggtagcccaagtgtaattttaagtcttgaacagtactagtttttgtttgtttggttggttggttggttttttttttaattccaggtttgttgttccttttgcagtacaaccctctctgaaactcactgggcttcttatctgtttgattacagtgagtcctatgtgccaattaccctgcctgcaggttttttttagagatgttattctcagatctgctgtattgctttgctttctctccgcatacttcactctctagactcagtgagagctacattgggactatctgacttctgcagaaaggttgttttcattctgatctctaccctgagtcattttatccagttgaaatgttttggggtaataacccctaatttgatatttgccctgagacatcatagtgagctcaacaattgtaacaataggcatgaaggctatacctttaatcatatctttgatactgattaaattttaatgggcctctgtcattcaaagtcttcctcagctatatttcttactgtttagggcctttagtagttagcttttccaaaattgcaaggcctcaaatttttggactctctgaattccatttcatttctctttgcaaactgacattactttttgattaaaggtctttccttaataccctgttaaaagtagtcaacatactctactaatattctattttccattatcttctcctagaacttaaacacatgagatatgtgatctgtctcccactttatcaaagacaacatttaaccaaatgtttttgtactgcataacatagattgctagctcttcagcttccagtatcaattttctcataatctgcctgctaagtcaatgccacagagtttaggtttttgtaacagcagcgctctactcctgataccaatttctggactagtctagataggctttgttatgctgtgatggcaaattaaccctgaaatatcaatggctttatatgaaaagtgtttatttctcacttctaaggcatatctaagacagatcagcaaagggtctctcttccatctagttactcagagacctaggctaacagaagagccacatctagatcctcactggtcaccaaagcagatgtagagagagtacctggagagttgacatcttctctgctttggcccagaaataatagatgttatttccactcagtttattggcaaaattagttacatggccctgcctaatttcaagatgcctagtaactataggggatcatatgaaatatttggtgagcattgcagtctcttctacagagaaaactcttaaagtatatgcagttatgaaaagtctatgtaaattaacggctgtatgtatttgctaaggctgtagttccagagctattagaaatcctgagctttgtagtcttggaagactagaccagataaacaaaactaattcttctttcaatgggttaataatgtatttatcaaacacattaaggaatgatatggacaaaaattttaaagtaagttcaagaaagagatgtattgaaagcaatagctatatatatagcaagtggactatagaaaacaagtggtatccttgaagtgtatccttgagctttggaaagataatcatgtgaataccatgctctttaacagggagacacttgggacatttattagactgaatgatgggcttgagagaacacttgtctgacctggtattgcactttttgtgtttcaggagaaatgatttatacctatagtgtatccatatttgaagtctagtgtggttctgctttagttggcagtctatgaataatatccttttttaaactatcaaaatttacattacgtacctctttccagacatgtggaatgggattctactattactagggaatggattatgatgaatacatcttctcatgtacaaaatagaaggatttaaaatataactttgaatgtcaattaataggattattaaaaatagatttgtttggtccttctatgtcatgtgttaattagaggctaagtccttgaaaagttaatagatcaaaattaatacagagtaagtattggacaaagtcactgtaataataatgctattcattgagttatcacataaagacttttacgtgtgttatctcatttatttctcataataatccagtgaggcagtaaaattattatccccactttaaagatgtcaaaactgatagcagtaggttcagcagctgacccagtgtcacacaaaaagtagcaggactggtattcaaacccaagcagtctgactccagaagaccacattcttaattccaactgtatactagtatccttccgtttgatagaaggttgtgtttttattagatcatcaaattgaaccatctcaagagtgtatttgtgttgttagagtgtaactcagtagttatcatgtcataatcaactgaggggaattcttcaagctacatagatctttttcctgctcttctcccttgcatcacagtcagtcattcattctcacatgtttacctgggtgaatatataactaaaaaagaactttcatgtaattttaatacaccatcccacccaccacttctttttgagaaccactgctcttggttatattggtaactgtttttgctgtgtaaggagaaaggtgacatgtgaaagaaatataggtaattttttctgaaacacattaccataaattgatcctgagatacaatgcagtggttaaaagtaaaggattcatggtcaaacaaggtgttaacttggtgtgcagccctttattgttgtagtgatttttttagactgttttagacttgatagaggtctaataccagttcttactctagctgtgaaaataaaactctgttggattttcctttcttgttctctttgattagcaggatagataaactgaacacaagtctcaccctagctccacaacttactgtgtgaatttaggcaaattgccttaggatcctgtgcctttgtttcctaatctgtgaaacagaaaaaaaggaatatgggccaggcatggtggctcacacctgtaatcccagcactttgggaggccaaggtggatggatcacttgaggtcaggggttcgaaaccagcctggccaacatggtgaaccccatctctactaaaaatacaaaaattagctggcattgtggtgggttcctgtaatcccagcgacttggggggctggtacaggagaattgcttaaacctggttgggggacagaggctgcagtgagccaagatcgcaccactgcactccaccttgggcaacagagtgagatgccatctcaaacaaaacgaacaaacaaacaaaaaggaatatgtacttgatatgttgctgtgggaaccaaataatgcctatttgtaaactgtatagaaatgtgcccattttatagtaaacactcaatagataatacatatgatgatgatgatgatgatgatgatgatgatagaagagccagccagttccctacctttatgctcttgtgctcccaccagtggaaatctccctctaaaggaacaaaacagttgacaactgctagctcttagaagctgtagacctctaagtcaaagtttcatcaagaaactacatttttaagtatcacaacagaagcagtattaggaaagagattaaaggcacagaatctagactgagattacttggatttgaattctggttctgccttttctagctatgtaactttaagcaagttacgtattctctcagagagtcgagttcatcttctgtaaaagggggatggggaaacaatcaaaaacttttctcataaggctattattaagtacatattagcattactaaagtgtttgtaaaacaatgaatacatttgtataaattgataaagtttttaatttaatatatgtttatacatatggatattatgtattaaattatgttttaaatttaaatatatttgtctgccaacacatatgttattccatattaaaatatcttttcaattatttcatggaattctggaccaacagaggtgcaaacattaacctttagatttgactctgagcttcctagaagaccaaacaaaaagacactgtcatttatataatttttattatgataagctttccagtattgaatttattgccacttaatttctcaaacattaagttaatttcattatctgtaaggaaagcattatttctaccttctatacctagagagtttttctgaagatcctcttagataatgaaaatgaatatgctttctgtgttgatagaaaccctacaagcaaggtatatgggaagaagaagagaactagcgttttttttttttttttgcatgcctaatatatttaacaccttttgatattaacctcacagcagcctcactgactagataacttatcaataaaaatacatgactaaggttttataacaaattgtagtgctggaaaattcaacccaaacttacctccaaaacccagagagggcaaataattaaaatccagatgaatcacggagaattaatagaacaatgtaaacaaattcctaagttgaaatttgtataagcaaattgaaatttattcctcaaagaattgatataatttatgtaagctattttttaagatttagcataaattacatacacattaataaagcatataagcagagacatagcaaataaataagctctgcctaagaaaattttcattgacctgtgttttagcccaattagactgtgagataataatctagatatctgatacacatatttttatctaatcatgtatcataagctcttctaggaatagtatcagtatactatttatggtaattatttccatatacagaaattattgttctgtattaattattacatagtagtttaattgtaaggaaagttgttttagatacctggtaatttctgtacaatttatattttttcattagcaagggcttataatttaaactttctactttttgttaattttttttagtatatagtatataatatttatgttcttaacaagatatttctacaaatttatattgggtcctccaaaatcaatgcattttgagggtatgttacaacttgaatatgaagtatagcaagaaatatttttctctgtgtgtctaatgatccactgtgttgcctgtgtgagtataatgttattacaagcattttttgtaataacattagtacaaataaaaaaagtttctgtttttttttttatttttcctctaacaattttatatctgtaaggttttttaaacagattttggttcaggatatttacattaagaaataatattactgagactttgttcaaatagagctaattattgtccataatatagcataatttaaaataaatatgagcttttgagtaaaatttccctgagaaaaattccactatgtaatatatcaataaacttgggttaattatctaacttccctgaatcttagcatccttatctacaaaaattagaatgactgtatgttcattacagagttgttgggtaaattcaatcagataattcaacccaaattgtgaccaaatagtgtaatgcacatatagtgtaatatctgtatattacacactgtatgtctaaatggctagcatgttatgatacttaacaaatgttagtcttcctcctcatttttatgttaatttaattgatttgtggctgtcatcacagaatatagtatattctaaaataatgtttcttttacaataattttcaacatataagaagtaagtagttatccacagatagaattagcaacttggagtacatcagccatttccaatcataaatccatggatgggtactggcctctgacttcattttcactgtacaattagaaaaataaggataataaaatttattaagctaagttaatttcagttaattattgtggtctaattgtgttgtgattcagatgtcttccacaaaattattataacatagtgatgtttgagattttaaaaatacccttttgtagcaaaatcaagaagttagaactcctctgtcaattattcatctttatttctaaatttattttaaatatcaactctgccatgtactacttgtatgacttaggacaagttatttagcctctttatgatataattttatcatctatacaatggagatatcaataatgactacctcgtggattgttaagataaaattagataatacatgtaagactcacagagcagttctggcatataataagtattccataaagagctaaagctactgtcatcatcactagtctgtgaaatccaaaatgtgagaatcatccatttagataattcgtcttatgccaaaattactttaaaagtaggaaagcctatgtttacagatgttataatacctcaaagtcatagacagtctttgtagacacatgaagttgttattgaatgtgaaggtattttacaaaatatacctatttgctacaatagattgaatattgtcattgaatatcatctgtatttttatttgatgattttaaaaggcctatttttatattagactaggcttttgatgcttttgttaagtccaagaatacaattgatgcctatattatattttgcatgtaatttaattatcaaaatttttcttagtttttaaatatttcttaaactttttcatataccaaatgcataatgatgagagtctcaatagttctatttcaaataaaaataaataattgccaaatatggaatattatttctaatttttgttcacttttgagttaccatacatagagctctagaaacttctacaaactttatttatagaagtttaggaaaattagaacaatgtttataatttattaatttattaattatttatccaataattgaataatatttttaaaatagcttagcattttatttgaatatgaatagcatttgttctattttctcagaaggaagtgctatttttatctaaattctgaattattaatgccacactgtaagcaaaaagtacatccatgtttgaatggttgaagacgaagcattgcctttgagaaagaaaacagtacaataccgcaaatggttccttacagcaaaagactctgcttccttacatagttctagagaattctagcctcaccatttcttgagctacacctacttagaaaccttagtctgaccttttctaagtatgaaagatttgccctttgtccttatgggaaaatgagagggtttggtaagacctgctattaaccttcattaatctgcatttttagaacactaacaaaatcccattcctagaatgtaaaagctaagtggcagatactctatcttatttatcttttcatcactattacttagtatgatgcttgcaaggcacattaataggtgctcagttagcatttgtaaactgaatggatttcaagtccgctaaccaaaccagcacatatcaaatatgtgattacttttaaggagtcatgtttcaaatgggtcatttaattcatgtttcacactcttaggcttgatatccaagttatcttccatcattttgcattacatctattacaaaactgatagaaaccttgactgctacatttggagaagttagctaagcaccttattgagtaataatataaagttttgttaaaccactttatttaagggtgacttatattcaaaaaactctgcatatttaacgtatatacttgatgagtttggagataagtatacagccatggaactatcgacagaatctatgctataaacctattcattacctccagaaatttccttccaccttatttatttatttatttaggtgattgtggttttgatttggattttcctgatgattagcaattttgatttggattatgatgttttacataacaatggaaaatctcgtctcagcaaaatgttaagtatataatacattaactatacacattatgctataattatacatataattgtgttgtatagtaggtctctaggacttgttcatcttgcttaactgaaactttgtacactttgactcacacttctccacttccgtcttcccccatttcctggaaaatcaccattctactctcttgcttctatgagtttggccattttagatttatcatataagtggtgccatgtagcatttgcccttttgtgtctggcttattttgcttagcataatgtcctctgggtacacctgtgttgttgcaaatcgcaagattgccctcttttttgaggctaagtaatattccattgtatgtatataccacattttctttatccgttcaaatttaatggacatttaggttggacatggacatggttgttagtattgtaagcaatgctgaaataaacataggaatacagatacctctttgagatattaatttcattgcccctttggaagcaggattgctccatcaaatgatagttctatttttaatttttcccttttattgatatataataatttatatagttacagggtccatgggagtgtttgttgcaggcaaaaattatataatgttcaattcagggtaattggagtatcaatcatcttgaatgtttatcatttttagtgtattggtattctttcaagttctctcttgtacttatttcaaatatacattatattattgagaagtatagtcaccctagcctgctatcaaatattagattagaacttattttatctaactgtatgtttttaaccctaatcagtctctcttcattcactcccccgctccccactgcaacccttcccagagtctggtatctatggttctattctctatacccatgaaatcaagtcttttatcttctataagtgagaacatgcagtatttgtctttctgtgcctggcttgtttcacttaacataatgtcctccagttccatccatgttgctggaaatgacatgatttcattctttgttatagctgagtagcattccattgtgtatatatatattacatttcctttactcattcatccatcgatgagcatgtaggttgattctatagctttgctatcacgaacattgctggcagtaaccatgtgagtccaggtatccccttgatacactgatttcctttggatagatacccagtagtggaatggttggactataaggttggtatactttaagttttatgagaaacctctctactgtttccacagtggctgcactaatttacattcccaccaacaacatatgagttacctgttctctgcatcctcaccagaatctgttatttttggtctttttagtaatagccattctaacttgggtgagatggtatctgattgtggttttgatttggattttcctgatgattagtgacgttggggcatttttttatatatacccattggccatctttatgtcttcttttgagaaacaactattcgtgtccttttctcatgttttaatgaggttttttttgaaactgttgagttgtttgagttccttatatattctgtatattagtctcctgtcagttagtaatttgccaatattttccccattcagggggtggtctattcactctgctgatggtttcctttgctgtggagaaacttttaaatttagtattatccccccttttttatgattgtgcttttgagggctttgccataaaatctttgcctataccaatgtcctgaagatttttctctatgtttcttctagtagttttatagttttgggtcttaatttaagtcattaatgcatcttttgagtttacttttgtgtatgatgagagataggggtccgagtttcattcttctgcatacagttatctagctgtcccaataccatttattgaagagagtatgctttccctagtgtatgttcttggtagctttgttgaggatcagttggctgtaaatatttcaatttgtttctgggttctctactctgttctatgggtctatgtgtctgtttttataccaataccatgctgccttgtttaccataaccttataatatgttttgaagtcaagtactgtgatggctccaacttgtctgtttcttctacaatttttttgtgtggtttgttcttgattttctagctccttgagatgcatcattagattgttgagatgcattattagattgtttatttgaaatctttttggcttttttatgtaggcatttattgctaaaaacttgcctcttagcactgctttgtttttgtgtcccgcaaaacaaagtatattatgttttcatatgttgtgttttcattttcatttgcttaaagaaattttcctctaagaactgttcttatgttgctatgcccatattggcagcagtgggatgagcatgcttgatcttgggccccagaacagcatacactggcaccagtattagcaggatcagacagactgattcttaggcctctaggtggctgcttgcttggatgctggtagtggcagcagtggaccaggaaagtatgtatctctgggtcttgatcagtgtgcactggtgttgatagtggctgtagtcagagatcaccattcacagccccagacacagagctcgcaggctgtcctgctctctgcagcaacagttctgtagaggtggggaaggaccctgcctgtcacacactgtcctggacgctggggccacaccatcagtgggggcacagttgtcattcatagccccacacaggtagcctctgttcatgcacctcagcctccagtggcagcagcaatggctgtacttgtaacagtgtgcagacggaaagaaggcatcctactctgtacatatgaggcctagcagagaggtcattttgctggtgagaggggatctcactctctgcttgcaaggccaagtacagaatttgcactactgctggagacagagtcacttctcatagtcccagacagggaggtcttggcctctgaaaagcatgtgctttgtttcctttgtcccacggatggtgcgctgtaccatcctttccccaggaaatagtactccctgtggattacagcagcagtccccaacctttttggaaccagggaccagtttcatggaagacaatttttctacagatgggggtgggtattggggggagatactttcaggatgaaactgttccacctcagatcatcaggcattagttagattctcataaggagcacacaacctggatccctcaaaggcacagtttgcaatagggttctcgctcctgtgagaatctgatgcccctgctgatctgacaagaagtggggctcaggtggtaatgctcactcacccactgttcatctcttgctgtgtggcctggtttctaacaagccacggtcaggtaccagtctgtggcccagaggttggagacccctggaccagagtactggggactatgcagaatcttttgaaccaaccaacactgtgccactttagtggacactgggtggacactgagagatgtcagttggggctcatgggatgtagagatatgggggctatgattcccagggcaagatgcagtcccatggcaactgtgccctcacaagggtgcccagctgctgctgcttaggtcttggcagggacaggaatgagtgacaatgtgcaagtcctctttctggagcaatgtcctcatggaccctgcaaatcactccctatgctagcgtcagggtttctgtgggcgtaagaactctcccattgctcaaattgcagcagtccacagtagggatgtggactgctgaattacgctttacctacaataccaagccccttggggctcccaagccaaccttctctgagctggctgctgggtaccttttccttctctgcctcaggtgtttcctgtggcatctctgttagacatcagtattctttcctagatgttctattcaaggtatgattatctattcataattttggtgcttccttctggagaaggcaggtgcccaatgtctgtagttagccatcttgaaccagtgttcttatttttaaccttcaggaacttccatagtgttttccatcgtgcctgtaccaatttacattcccacaaacaatgtacaagggttccattttctccacttccttaccaacattgattatcttttgctttttgggtaataagcatcctaacaagtgtgaggtgatagctcattattttgatttgcatttccctgatgggtactaaagttgagcaccttttcatatacattttggccatttgtataccttctttgaaaaaatatctattcaggccaggcgtgatggctcacgcctgtaattccagcactttgggaggccaaggcaggtggatcacctgagttcaggaattggagaccagcctgaggaacatggcaaaactccgtctctacaaaaaatacaaaaattagctgagcatggtggtgcatgcctgcagtcccagctatttgggaggctgagttgagaggatggcttgagccctggaagcataagttgcagtgagctgagatcacgctactgcactccagcctgggtgacagaggcagaccctgtctaaaaatcaatcaatcaatcaatcaatcaatctattcagttcctttgctcatttttaaattttgggtttttttcttatttttcatttttaaattttattgtttttgctattaagttgtcgattttgtttatattttttggatattagtcatttaccaggtatatagtttgcaaatattttctccaaagctatgcctttttattttgctgattgtttccttcgctttgcagaagcttcttagtttggtgtaatcccacttgacagttttaggttttgttgccagtgctcttttgtgtcatatccaagaaatcattgacaaagccaaatataaaattcttaacttcaccaatgaggcagttttgacttcatgaggttctgaaactttttcctagagttgaatcaaataatacaatttaaattcctaattctttaacaaattaaagaaaaactatttcctccaactatagtaaggcaaaattttggctattaaacaactgaactctttttaataatgtgtgaagctaataggtgcctgatgggaccctattgctttgaggatctaattgcagacagaactatttattctttgattactagacttgtaaagcaggagttcaggaataatgattagcaaacaagattgtgcaggaatttgaagaataaattgacatatatcactgaaagcatacaaagtttcagtcaggagccatgaacccaaagcatatactgttctaggtacattacaggtgaaggtcgctgcattacatttaagagcctacgggcccttaaaagtttaacttgacaacagatgttagattgttcaagtactctaaaaataatcccttaatatatctttgtaatacaatagcacttgtattcctaaaataattttataaattttataaataataaaataatttttaaaaaatttgaaataaaatgaaatataatcctataagagattcattgaatgtttttaaaacattttatttatttatttagaatgcattttaacctactgaaatccaatataaataatatgtagaaaatagttataaaaaacaagttgtagttgtagaagacattaatgttttagaacaaagtatttcaagcttagtgttcaatgtatatgtgatgctaaggtcattatcatttggccacagatataacctatgagtaaaggagagtccttgttttttcataacctcttctgaatgcaacatccctctttataataggcaatattgcttccaagttgccatattcttaaaaaggcactgagtaagatcattgatcactgatatttgacatatttatgtactgaagagcacttttgtggaaaattcttccctcaattaattagatatgtttatatgtttatatgtaacagaataaaaagggaagatttcattcaaataagggcatttcaccagcccttttatgattatatatagtaatagttttttactatttaaatggctgaaaggtaaccacttttttaaaaatgttttttacatatatttctgttttaatatcctattatgggcagaaatgaaatgggacttaaattcaggttgttaccaatagtctaagattctaagtgcatcactatttcatgtacgcaaatattggctgagatttagcagaggtattgaaccagacaaatctatttatgcagtggctgttttacatttcttctatagagtattggcttcatgctttttgttagcttcagtaccttttgtccaaaccaaattactcacaagctgaaatgtaagacaattcaagattaaaaacgctatacaatcaggcatcacttaatgaaaagataccttctgagaaatgcctcattagacaagttcatcatagtatgaacatcacagagtttccttaaagaaacccagataggatagcctactacacaactaggctatacggtatggcctattgctctcgggctacaaacctgtgttgtatgttactgtaccgaatgctgtaaacaactgtaacacaataagtatttgtgtatctaaatataaaaattaagtagagcaaaaatgcaataatgcattatataagataaaaattgggcacacatatatagggtagctccattaaattctcatgggcgccctgcaatatatacagtccatcattgaccagaaacataattaaacagcacatggttatctttgacaggagggtgctaggcataaggggccagaagcctactggcttttaattctcctgtgaatggaaaatataatgtaagtcaaatgactatccatatagtatgaagtcataataccagatgactatccatatagtaacccatgtataatccctaaatcatagtacttgttccttatctatgcctctttctatttgccattttctgttcctaaatataactttcctatttttcacttctactcccacagtctacacagacgcacacacacacacacacacacacacacacacttcccactgtatatcagtgtataaaaactagacctgtctcatgattggttgtgtttacaaatatgttcatatttatagtaataaattactgaaaaatatgggcatatatgaattcaaaaaataaaatgtttaatatataaaagcatgttctgaataggtacaatttattatagaaagactttggatgctctaacattatggaactaatgtggataagttctttggaagtaaatactagacaaatatcttgattaaagtaaaattcaggtagcaatgttaaaacttttcataatgtaaacagctatgcaaagcatgacttttgaatttatatataaaatacattttcaaagacacagatactgctatattcattttgtgtatactgaatgttatttctgacattcttttagattcttgatagtaaataaatgatattttggagagtactaaagcttatttaaacatgatttgatgttcaatacaactaacaaaattgtagtggaacacaatgatattataaaaatgaagcttcatttgggaaagcatttccccaggtgggaataaggcattttctatgactagtctaaataaaagattcacttttccttgctttattttgggagggtggaggatggtagaaatgcaatttcaagtgaatgagtgcattctatttttcctgtttttttttttttacaaatgttataaaatcacacacacacacacacacatgcacacacgcacacacacacacacacacagagtatcttcatccatttttatgactccttagagataaaaggggttgagaaacatggtttggatttagttaatatttcctaaataccaaaggaatactgtttttcataaaataagggtgatactttcaaaactgtgctcagagaaaaatcaactgacacattttttaaaagaaaagaaaaaaaagaaaaattcaaaaccctttattagtttagaaaaggaccgttgtcaataccctgagttctaccaaattcaattttggctatttagtacaaatctgaaggagaatttttttatgctcatcagtcaggtccaaattcaaggagccattatcaaagttaggaatttaaacaacgctggaattcaataatgtgaaaatactactgattatttttataggagttttattctgaaaagtatgaagtatttataaataatatttcaacattcttttttttgaaagatggaaggtgaagttagtaacgggtaagttattatttgaatctcctagcattcagtccaagctttcaatactttaaacctaatatgatgtcattctaaaacccacgaggagtaaatgtgatttgtattgtattctacattcagtatgaagtgcacattcatgatgttgataaccttatatattagaactatatcatcatttcctataatataaacaaagaaaatactaaggatattaaattgaataaaaataaagaacatttacatcttgatgcttaggtaatgataaagattataaaataataagaaattcattgactattcccagccatttaatagtaacatcacaatagttgaagaatgaatgcattggtttgctaaggacaatgtccttcagctccatccatgttcctgaaaggatacaaccttattctatttttatggctgcatggtattccatggtgtatatgtacaacattttctttttttttttttgagatggagtcttgctctgtcgcccaggctggagtgcagtggcatgatcttggcttactgcaagctccacctcccaggttcacgccattctcctgcctcagcctcctgagtagctgggactacaggcgcctgctaccacacccggctaattttttgtatttttagtagagacggggtttcaccatgttagccaggatggtctcgatctcctgagctcgtgatccgcctgccttggcctcccaaagtgctgggattacagcgggggagacaccgcaccctgtcacaacattttctttatccagtctagcattgatgctcatttaggttgattccatgtctttgctattgtgaacagtgctgtgacaagcatacctgtgcatggtctttataatggaatgatttaattagctaggcatggtggcatgtgcctataatcccagctactcaggaggctgaggtagaaggattgcttgagcctgggtggcagagattgcagtgagccaagatcgtgccactgcactccagcctggttaacagagagataccctgtctcaaaaatcaaaacaaaacaaaataataggacaatttatgttcctttgggtatatgcccagtagtaggattgctagatcaaattatatttttgcttttgggtctttgaggaatctccatactgtcttccacaatggttgaactattttacactcccaccaacagtgtgtaagcattcctttttgtccacaaccttgctagcatctgttatttttttgactttctaataatagcctgtatcagtccattttcacactgctataaagaactacttgagactgggtaatttatgatgaaaagaggtttaattgactcacagttccacatggctgagaggcttcaggaaacttataatcatggcagaaggcaaaggggaagcaggtacagtcatcacatatcagagcgagagagagagagagagagagagagagagcgagcgagctaggggggaaatgccacactttaaaaccatcagatctcatgagaacacagtcactatcaggagaacagcaagggggaaaatccacccccatgatccaatcacctcccacctggcctcttccttgacatgtggggattacaatttgagataagatttcggtgggaacacaaagccaaactatatgatagccattctgactgttgtgagatggtgtctcatgatggttttgatttgcatttctctgatgatcagtgattttgagctttttttcatgtaattgttggccacatgtatgtcttttgaaaagtgttcatgtcctttgcccactttttagtgtgttttttccttgtaaatttgtttaaagaaccaatgtattctgccatgttaacagaatatcacagttggaatttatactttacaatacaagcatgttttgtatttttttgagataggatcttgctctgttgctcaggctggagtgattatggctcactgcagcctccaccttctgggctaaagcaattctggcacctcagcctcccgaatagctggcaatacagatacataccaccacacccagctaatttttgtattttttgtaaagacaagttttcaccatgttgcccaggctggtctgaaactcctgagctcaagtgatccacctgccttggcctcccaaagtgttaggattacaggcatgagccactgtacctggcctatttttttaatcaataaaaaatttctgtgtgttacatatataattctattataatttacttttattaatgtaaatgttatgacatgtatgatatgctattttggaatctcatttgagttagaggtctttatcttaatgcctctcttaatgctatgaaaacaaagcattttttataactaagaagacagagcctccttttgaccgtgtctttgctactatcctgtacttggctgtcctttctgttgtaaattaaaatagatgaaggctgtcgagccaagccaatgatggaggctaatttaatgcgatataattgatgaactctaaattgttccacttttcccttttgaaacacactaagtagagcttaaaatgccagatagagtattttgatttatgctctttgtcacattaatactgaaaaactcattgtagtgatagagaaatgggaattaaccctttatagatactttcatagtttctgtatatttggctgtacaacaatcagagaaatggacccagtttaaatatactaccagaataaccattaaataataataagaagaaatgtaatgaagaggctactaatttaatgctcatgaaactagttaaatgatatgaaaacaaacaactctaacagaaaaaaaatcaaattaagtccaagtaaaatactggatttatatccacatgatttttgtgaattttgctaaatctgatgcccttgaaccagaatacatggagaatttacaaataaggacaggggaaatcatgaaggcattttaagatgatgaattttcttaacatgtggcatactgatagagttcagttgaacataaagttgctacagttgttgctagtgtcaagaagaaatgtgggctgggcacggtggctcaagcctgtaatcccagcactttgggagtccgaggcaggcagatcacgaggtcaagagatccagaccatcctgaccaacatggtaaaaccccgtctctactaaaaatacaaaaattatctgggcatgatgtcgtgggcctgtagtcccagctactcgggaggctgaggcaggagaatcacttgaacctgcgaggcagaggttgcagtgagctgagatggtaccactgcattccagcctggcaacagagcgagactccatctcaaaaaaaaaaagaagaagaaatgtgagtagaccaaaaaaaagagcagctatccagaaatggccattactagcaatattcgtctcagtgctttttgtattaagttattaaattttagtaatatttaaaagttaacaaagtagccagataaactaaatacactaaaggaaatttcatatttatatacaccagcaacaaatagtaaatatgatttttttaatctatattagcaacaaaaatggctatttaggaataattttaacagatgctcaagattgttatgtagaaaattatgaagtcataaaattgtaaagttttataaagctttgttgagagggattaatgatgactcaaccaaatggagaggaatagctactttatggataaaaagatctagtaaagtcatcaattctactgaatctaagaagattcagtgtagtaaagttatcaaattgatctatagatttaataaaattcccattgcaacatgtttttataaaacatgaaagatagttctaaaatttacatggaaaagcaaagtatcaagaatatccaagacactcttgaccaggaagtataagattagatgacttgcctttcaagatactcagttttgttttgttttttaataaaactagagtaattaagaaatgtgattttttgcgtaaggataggcaattagatcaagagaacagaataaagagttcaacaacaaactcacatagaattaaaaacttgatatgtgtcactgcaaattattgggagtaaaatgaataaatgagagcttcacacagaaacataaatggatgttagaaacataagctgaagtgaaaaaagcaagatataaaggaccattcacagtcagagaacatttatttgtttgtttatttatttatttatcatttattattttaaataattgcagcttttattttagattcaaggatacatatgcaggtttcttacatgggtacattacgtgactgaggtttgggataccattgaccccgtcatcgaagtagtgagcatagtaccccatagttactttctcagccctttcctcctgctctctcatctctagtagcctcctctgtctgttgctgtcatcattatgtccatgagtgctcagtgtttaactcccacttttaaatgagaccatgtggtatttggttttctgttcctatgttaatttgcttaggataacggccttcagctacatccatgttgctgcaaaggacaagatttcattcatttttatggctatgtagaattccatggtgtatatgtaccacattttctttattcatctgtcattgatggacacttaagttgactcaatgtctttaccattgtgaattgtactggaataaaaatacaaatgtgtgtgccttttttggttaaatgatttatttcttttggatatatacccagtaatgggattgctgggtcaaattgtagttctgttttaagttctttgagaaatcttcaaactgctttccacagtggctgagctaatttacactcccagcaacactgtgtaagtgtttctttttctctgcagcctcaccagcatctactgttgtttgactttttaaaaatatgcattctggctggtgtgagatggtatctcattgtggttttgtggttttgatttccatttctctgatggtgagtgatatgaagcattttttcatatgtattttagccacttatatgtcttcttttgagaagtgtctgttcatgtcttttgcccactttttactggggttatttgacttttccttgttgaattgtttaaattccttgtagattctgcatattagacctttattggctgcatagcttgtgaatattttctcccatgctgtatgttgtctgttatactttgttgatagtttcaggctttaaaccaataacagtaaagaaggacaaagaagggcattatatattgataaagagttcaattcaacaaaaagacttaactattctaaatatatatgcactcaacgttggagcacccagaattataaaacaagtccttctagacctatgaaaatacacagacagctacacaataatagaggggaagtgcaacaccccactaacagcattagatagatcatcaaggcagaagactaacaaagaatttctgggcttaaattctatgcttgaccatttggacctaaaagatatctatagaaaactacacctgttaaccacagaatatacattcttctcatctgcacatgaaacatactctaagatcaaccccatgcttggtcataaaacaagtctcaataaatttttgaaattgaaaatataacaaccataccctcaatccacattggaataaaagtagaaatcaataccaataagatctctcaaaaccacacaattacatggaaatttaaaaacctgcccttgaattgacttttggataaacaacaaaattaaggcaggaatcaaaaaattattggaaataagtgaaaatatagatacaacataccaaaatttctgggatgcagcaaaagcagtattcagaggaagcttatagtgctaaacacctacctcaaaaaattagaaagatgtcaatttaattatctaacatcacagctagaggaactagaaaaacaaaaactaaccccaatgctaaagaagaaaagaaataactgaaatcagagcatagctgaataaagttgagacacaaaaatccatacaaagaatcaacaaaaccaaaagttggttatttggaagtataaataagattgatagactgctaggtagattagcaaacaaactgaagaagatccaaataaccaaaatcagaaatatcaaagatgatattacagccaatcctgcgaaaatataaaagttcttcagagaatattatgagcacttctgtgcacacaaattataaaatctagagaaaattgataaatttctagaaacacacaatttccccaagattgtatcaggaagaaatgaaatcctgaacagaccaatattgagttctaaaactgaatcagtagtaaaaacctaccaaccaaaaaaatccctgggccagattgattcacagctgaattctactagacatacaaaggagagctggtattcattctactgaaactattccaaaaaatacagcaggagagactcttccctaagcattctatgaagccagcatcaccctgataccaaaacctggaaaagacacaacaaaaaaagaaagttatgcaaaattcctcaacaaaatactagcaaattgaatccagcagcacgtcaaaaagttaattcaccatgattgagtagctacattcctggcatgtaaggttggttcaacatatgcaaataaataaatgtgattcaacacataaacagaatgaaaaacaaaaagtttatgatcatctcaatagacaccaaaaagttttcaataaaatccaacatcccttcatgataaaaatcctgaaaaaactagtcatcaaaggaatgtacctcaaaataataagagccatctttgacaaacccacagccaacataatactgaatgggcaaaagctggaagcttttcccttgataattggaataagacaaggatgctcactttcactattcctattcaacatagttctggaagtcctagtcagagcaatcaggcaaggaaaagaaaaggcatctaaatagtaaaagaataagtcaaattatctcgctttgctgatgatataattctatacttaggaaacactaatgactctatacttagaaaacactaaagactccaccaaaattctcctggaactaatcaacaacttcagcgaggttttaggatacaaaatcaatgtacacaaatcagcaggatttctatacaccagtaacattcaagctgagaaccaaaccaagaatacaatctcatttacaatagtcacacaaaaaataaaatacctaggaatccatctaaccaaggaggtgaaagatctctacaaggagaactacaaaacactgctgaaagaagtcatagatgactaatgaaaaacattctgtactcatggattggaagaatcaatatctactgcccaaaataatctacagattcaacactattcctatcaaactaccaaagtcatttttcacagaattagaaaaagctattgtagatttcctatggaaccaaaaagaaaaaaaagcccaaataggcaaggcaatactaagcaaaaagaacaaactatagacttcaaactatactacaagagtacagtaatcaaaacagatggtactggtacaaagacagacacatagaccagtggaacaagatagagatcgcagaagtaaagccacacacttatggccctgtggtctttgacagagtcaaaaaaaataagcaatgaataaatgactccctattcaataaatggtgctggcatagctggctaaccatatgcagaagaatgaaactggacccctacctttcaccatatacaaaaattaatgcaagatgaattaaagatttaaatgtaagacctcaaactataagaatcctagaagacaacataggaaacaccattctggacactgaccttgggaaagaatttataactaagtcttcaaaagcgattgcaacaaaaacaaaaattgacaagtcagatctaattaaactaaagagcttctgcacagcaaaagagaacattgttataaatatcaaaaagtaccaaaactacttatgacagtggttacctctggagtgataagcagggagataaaatagggaagtagcacataggttgatggatgatctagtaacattctggtttttaggttgagtggtgagttcatggatgttcattatcttatgtttttaatttaataaatgcatgtaacatgcattaacttaatatacaaacatatatgtagataatatataaacatataatcttttgtatatttaaaaatatatttaaaacaaacatattaaagaaatgaaagaaagaaaaccagaatgctctataaaaatagaatagtttgggggaattttctttccaaatatcaaaatttactgtggagctttctgaaggataaatcctttatggaactgaatagaaagtctagatttaggcctcttatcaaatatatggaaatttgatctacggcttgattttcaagtcagtgggaaaatgatagaatatttaattaatgatggtgggacaactgactgtggaaaaaaatgaaatagaatcccaatttgcacatgcacaaaaatgaatcccagatttattaaagacagtcagttttcacttaaaaggaagaaaatttttaaacttgaaaaagtataggagaatatttgagacaacagaaatgtattcttttacgattctggaggctataagtctaagatcaaaatatcagtagggttgtttccttctgagagctgtgtgtgcctcttcctagcttctggtgggttgctggcaatatttgacatttcttgacttgtaagtgcatccctttgatctttgccttcttcatatggcattctccctatgtctctgtctctctacattgaattgtctttataaggaaactggtcatcttgaattagggggcccaccccattttattgtgacatattaactaattacatctgcaatggccctatttccaaataaggccccactctgacatacgagggtttaggactttaacattacctttttggggagacatattttcaacccatgtaattgttatttttaaattgtatatatgagttatatgtactattttcaggatacatttaataattttatttttaggaaaaatattaagcagaataaatatgaacaataactattttgttccttaaactaaaatttttaagctaaaaaatgaaagctaacacacctaggttcgccatccctatagaatactttttgtgatatggggtatacggtcttgcctacctgtctagcttcattcccaccacattttcttatattctaaagaaagcaaaatattgactgttctatgctattttatagaaatattggtgtctttccatttcctattatagtctttctgcttattatatcctcatctttcttcttctatctctttctcctcctttcttcttccataaccctcttctctttctctttcttctcctagttaactccttcttctccttcacgtttcatgtggaagccttcccggccccactctccagtcactctcatatgagacagccctcctcttttgcttccatggctgcatgtggatttctctttcattgcttatttgatttatgtgtactgaagacagagaatctcaatgcctaggatgatccccgaaatctgatctgtactcagtaaatgttaattgaaccaaaccaatgatgttaaatatctcatttatgtttcatctatacctatgaccttggccatcagattgcctgcttcctctggatcctgagaactaaaaatactgtctgtatgcttctatttttcaagcacaagtacacattatagtgattcaaatactaatggatattttagcattacatctagaaattttcttcacttcccagaaaataagattggttaaaataatagaggtattgattttaaaaagcagggaatatgctgtatatttattacttctcagaccagtgatatttcttcatttttttatacttagtgaattttatctcaagcctcattttactctaaatctgttctctactacaggatagctccttgctttggttaatatttaactttttaaaatatatcacattaccttggtgagtaaaatatgcatgtactataagattaccatcactataaaattatgcaggtactataagattattgtcttttactgtaagattactgcactatagattactgtaagatcactgtcataataaaatatgcatgtcctataagattactgtctcccaaagatttcagatttgtagagtaaaatgctttcactattcttttcctttgaattaccaggtcagaccacagggattatgcagaaagtagtttatttttgtgcgttgtgtttggtttctttctaaacaatctaaacaactttttctaggcttaaaaaattagtttgtgtgctaatgcattacttattgacagacatggtcatatttagtatctaattagtggacagagttaattttttcacacttcttacattttcttatatcatcccagcctcaggccgtcttccacttagctgtcatattagttccctgtggctagtacaacacaattactgtaaactcaatgacttaaaacaagttattcccttgcagttctgaagatcagaagtctgaaattagtcctaccctgctgaaatcaaggtctctgtagccaagcccctgctagaggctgtaggggagaatccatgttcttgccttttttagtttctaaaactgcatttcttgcattccttggctcctggcccttgtcaaaaccagtactatcacatcttactttagtggtcacattagcttgacttcttctctagttaaatctccctatacttctgttataagagcactatgattacagttagggcccctcaggatgatccaggaaaaaatccccatcttaagacttaatttaatcacatctgcaaagtctcttttgccatataaggaaacttgcacagattctagagattaggacctggagattttttgggggtgggcattattcagcccaccacagctactatctgaccaaatcacatagtgcacttttatctgccacagctttaatttcccccatgaatttatttaataccaatgttgtcttccatttttacacccatttcaaaactctgaaatagaaataggttaagtgcagacatccgacttgtatcacactgaccaccagatggcaaactttgtcattatatttttaggcctaatctgaattaatttgacagcctgagtagttaaatatgccaatttaaagtcatgtatagtgccatgcagtttagatcaactgaagttttatcacactagatcattttttatgagaacagctacacataatcagatattaatttgagctactttaatggcttctgaaaaagattacttccttatctagctaacgtcaacaactaagcatgcttctatttcacagaaaattcttccaatgcagtctctcttagtttttgagtaatttcttacaaattctaaatttaattgatatgattaattattaatctcaattttaattacttatatacaggatttttcctagaacttgtttcattaatgaattcaactcaggcaggtactaatccgtgtcgcttttatcctgtagtatcacataatatataataaaaataatggctacaaataaggcagctttctaaaatagcaaaaattattattgttctactgttttccaaaatcattgcactcttatcgtatcagtctaaacaattcagagacatcaaaataacagctaatattcttcttctttccctcttacagaaacttttatagaaaagttcagaaaatgtatatttaagtaagttaaaattcatgttctaaagataacactttttgtatttcccaggcataaagatataggtatagatgtggatatcaatgatatggaaatataattgggatgattcgtacagtgagttttttcttcttttgaacctcattcacaatatcatattaagtttattggccctcccctattccatctccccgtatcccccaagccaaagtaaacattattccaaatcttatttgtattttaaatatatgtgtgattatatatgtatgtgcatttacctatacatatatatacacattaatttattctgatttttcatataaagttatattcttaacattttccaatgttattaagattccttgaaaaatttttaatggtcatatgatattttacctttttggtattccagtttaaccaaatagaccaaattgtctccaatttttcactatgataaatgacactttcatagaaacttataaatcttgcttatatctctcattatgtatttcattaatatagaatcttagcggtggaattactaggtcagaggatatgtggacttttgatgtttttgatatctgttggcaaatagctttccagaagggccaaaccagtggcattctcttaatactcttgccaaagtgcttcattaatttaatttttgccaattaggtaaaaatattccttgatgtgctcctgtttactaatttatgactccctttcaagttatttaaattatatataatgaaatttatataaaataatcattatccagcttactgcactaatattgaaaaggaacataaacatttgagatgatgaatataatttataaaggtggaagggattacagaatggaattcagagtcctctttatcttttagagtagggttctctggcttcttacttcacatagatcagtgttgtcaatactgtaatagaaagaaaatgagaataaaagtaacactattaactagaattttttgtgtctttagcttttagtaagtcccataattgctttgtaacttcttttccctgagaaaattggagcctgaactctcagggttcttatgaagatacaatcactttaaaaagtgtgatcttcctaaggggaattattgttttaacaaaatctatatacgttgataattttaaaatatttgaaaatttataaactctttcttcctttttaatactgtttgttagaaatggctaagatctttgtataggaaggggacataatttcaagtgacattatatttgctcttcctcttttgtttgcactagagaaagccttgccatatctgatacatcattgtctgaaggtatgcttgcgtcatttccaattaaatgttttaagtcagcagtatacagtaaattatcataaatgttattgtaagttcaagctgaaatgttagcaagaaaattgctaaaggatatcatttaagctcttactggttctgtgtatttgctaatgtctgtggtgtatattactttgacgagcctacagtgacttctaacttgaattaaaatacagttttggttaattttgttaaggtcaagacaagatttaaattagaatataatttgcttagttatctcactttttttgaagcaagtaagcaatgaattgggaaaataaattatgattgtttacttaagattctcagaaagggaacacacatgcttcgttgacaacagtggcatcagtagactgaataataatttatgctatattcattacttttttattcctgatggaaagaagagctggttaaaaggtagcagagaccagttaaatgttcaggtctattttaataatatttatacaaattcattgactttataataatttgcatatttatttgaattttgacctacttggccttagaattgtcagtgaatataaggcagtttctgaagaaagcccgaaacactcactacaatgctagaattcaatcggtatttgttggcatgtcacacattcagataccttgcatgtctaattattatatactgaaatatatgtaatgaagagcaaatatagtgaacaaaatatatattgggtgagcaaagtttatgtcaagtaaatgattgacacaaatgtagttctgcttttttggaattctggtatcacaaacttattccaatatatctgaagagtaaaatcttgttcctgtggttactgtaactaaaagggaatggaaaaggcagggcaggaaaagatttatgggattcagagatgagaaaatgtgagagatttgaagaaaaagaaggtagaaaagaagagcaatgtatagactttgacaaatgagaagaaataatgaacaggaatttatagtataaagaagaaggataaaagggtacatttagtctcacaaaactagaattgtacaataaaagaattattctaacccaaattatttaattatcacaatgttgttattcaaatcctgcacatcctttgtctcacagacatctgaaggcctttagtaccagtccagtccatgacaatgtcttttcctaaaatctcatcacttgtttatgctacttacttgacaactgattgaacacttgtaattctgagttgttctgtgattaaaatctgctattataagttaacattttatgctttaaatctcaattttctaagtagaatacaaatctggaagacaagcactctgtcctatttcttgatagtttctgtagttttagcaaagcatcttgcattgtagagggatctcaattctttaatgactgagtgtaatatatagcatttttcaccaaaaagagtcatttatcctatagtaaaaaaaaaacaataaaataacactgaaagcatgcagagacttgggtgaaatttagaagctttggaacatgtatttcatcagtaagttatttactttgtttatgtgatagtcctgacatggaaaatcagtgtaagccaagatagtattgacagaaagagcataataaatagaaaaggggtacatgaatcagattatttacattttgaagatggtggctgcaatgagtactgcacttgaattaatccaaaagatctcccttgagctgaaagtgtgtgtagtcataattgcgtgacctgtgacacattgtctttgtcccactggcaggttacaaaattggcactgaatcaagatagagtaattataggaaagtagaaactgtctggatattccactgaaagctgaagatgtgatccattcttgatttgctttgctaatagctttaactttgagaagacagagagaatagtaagataaacaaccaacaggtgggggatgtaggagtcctgggagagagaaaattatcatgccatttgagagtatataatataaggaaaagagaatagagaagtgaagcatttacatacccccaggttttggcaaaatgtattccaaaatgtttacaggaaagctattttgattctgtggcaagagagctaaaataaaataccctaataaatcattcattcatttattcagtttaagtaatggtattagaaagggtaaagctataagtgagttaagccttcaaaatgaactttttttctttttttgttaggataacctgactgatacagcaaggttatgctgcagatatgatatatcttaactttgtaatggcatttatgaatatctggtgttcttttgaagttgacagaaaaatggacactgggtaatagcatagctattgttggtggtttctgagaggggccaataattagcactcttttctttctctgggttctaaacaaataggaactaacagttaatttgaaaatactggtcaatatatcatttttattattgataaaagtcatgctgcaggacataactttgggtccataaaccaaattattttgctaattctgaactcaagaattaggcagattttgtcacctgccatggataatacattaaggtatgctgcctcctgtgggtaggcttcccagataagaagttatgagagacaggatccaaaccaaactcacatcatctgcaggcagacttgcttctaaaaggaagagaggcagattcatctgtagaattaatcacttcacctccttggaacacaatgagtaagagcaggagagaagctaggagagtatctatggaaaattcctcctcatcaaaattaggaatggcaaaagcttttcccctctaactttgccttgcatctgttctcttaggccactgagtttaaccataaagcctgtggtcaactatgtgagggaggagatcagcagtttatttgggcaggaggcgaattctaatgtcagctgctttgggcattatcctgagatccatggtggtcagttttgattctacactgagaagattctgaaatgggttggaacaggacatatatcaaatcagcttcaatgacactctgtatctgaagctggaaatttaccgccaacttatttcttatcttaaattatatataactctatggccatattaaataactctaatactagaatgtgtaaagatacatcagtaataaaattccaaaaacatagaaatgccctaattaaataaaatctcctcactttatcaacttcccaaggaacaatcattaaagtttaaaagattatatttcttggcaagttaaaaccataagtaaagtctaaaattattttgcctttgtgagttaaaaattcttcaaataaattccaaaaccattcttcagtatttcttattaaaatattaaacattcttcaatattagtctcagccataagcactcaccattcacaggaagagttgggattgtctgtttctcaccagaatgcctagagctccttcagtgtcaacactgctatattagttcaatgccaagccttctgtgggcctgattttaaataactcaaattattaataatacatggaaaattttcagagcactggccacacagtgaccaaatttagaaagcagaccaattcctaccctttaaatgagttatctcaggcaaaatgatatgcctaaacctaattcttagtgtggccaaacaccataccagagactcagtggtatctaaggaaagaagggtagattgtaaaccctgattttaatcttgacatgatactattggtctataaaagttgtccagaattcttgagctatgggtttaaatcccagtgggagaaatccctaagcaaatggttgattttggtattatgcatacttacctcttagagaaacattgctgccttcttgcaagatttagaaatttgtggctgggcggagtggctcatgcctgtaatcctagcactttgggaggccaaggcaggtggatcacttgaggtcaggagttcgagaccagcctggccaacatggtgcaaacactgtctctactaaaagtacacagattagccaggcgtggtgatgtgcgcctgtaatcccagctactcaggaggctgaggcacgatgatcgcttgaacccaggagacggaggttgcagtgagccaagattgtgccacttaactccaggctgggcgacagagtaagacaatgtttcaaaaaaaaaaaagaaaaaaaaattagaaatttttaatcatatcaacccagtcccgagcacatcttattcatgccttctcctccaagacagtatttttaaaactttagtttccatttatcccaaccctaaattgagagtgactgtgtttggtgaatagcacccatgcttttgtgactaactagaggcatttcaatcttattttgctgtggctgttgccactgtatgtctctatgactttacttcccaggaagtatttgtctctcctctgtcattagccaattcagagacaatctaagaccacatggtagagagtgaccttgagcttgtgttcaaactaaacgattgtaagtttcatccataggtcctatcttagtcctaaattaatttttaaattcaacaaatatttattgaacatcttctatctaccagatactttctagatgctgagattaacatacataaaaatccaagtactatcagtagagacaaactttaaataaacaagcaaaatatgtagcatattagatgatagagaataatgcggagaaaaacaaaacaaggaagagggaaagtggctgtgtgtgtgtgtgtgtgtgtgtttgtgtgtgtgtctgtgtgaagatgattgacattttaattgaggtggtcagggaagaagtagaaaatgaaattttaggtaaaggaactagtgttggctacttaagcctaacactaaccatttaaagctcatgcacattctgtttatatatatacacacacacacacacatatacacagtaaccatttaaaactcattcaggttctgttttctatctatctatctatctatctatctatcatctatctatctatctatctatctatctatctatctatctatctatagtctctccataagagattgaatgagccaagaaagctgtctagtcatcagttgctgaaggactggctaagacagaaatacacagatacgtttctcagttgccccaagtttgggactcactcctcatatatgtgtacaaagtacaaaaattaaaattcaagttccgtaaatttagaacttgacttctttgtagtttactatgtttggtaacagcaaatattctgctcaataatttccaaagcctttttttccatgtgattaagtcattgcctcagcaaagcttagaaatagttgcatttgcatagtaaatggcatattaaggccttggccctagttgaagcccagtgatcttcatttttgttttctggattgccccatcacttgttctatccttaaggaaatggagtggcttatttgatttctaaatttaagtgaaataaacagcatcagttataaagatgatgttgtaggaccttttccttagttcagctaaaaatggggtccttatcacatgaccatgaaaggttaggctcacagatacattgaagggtgggaaaaattgaatttattgggtgaaaagaaaaaaaaaaactcagcaaagtgagagaatttcctgttaacaggcccccatctcaccaattgactcccaggtaccaccctagaacaggagaggccacgttcctcccgctgcaaacagcacgaactttctgaggctccacccagtgtgcattcctcccattgcacaggcctgtcaaaggttctgccaggcggcccattttacttggctatctcaatgatattatgttctttatcttcactttttactttttaacttgttcagaatcccaagcggatgagaagggtctacttaataatagaaaccttatcagagaccccaacagttcaatagattcattattgattgctatgtaagtgtccatttctagagaaagggtaatgaagcatgtatttcttttctctgatccacttaaaattttcatcaaccaagaaataaatggcctgattatcaaatttagatatttatgggaaaattcatggaaaggaaatatattagaataaagagaatttgtagattaagtgtgaaatatatagaatatatttggtgaaagttaaaatgcttttggtaaagggaagaaaatcatagggttagatatgtcttcttagcaggaatatatcataagccaatacattcaagaaaatttaccagttggttggtgaagcagacaaaacacaggaagacgctgcaaagtttttgggagcatcattagaccaagagaggttgaatgagccaagaaatctgtctggtcatcagctgcagaggggctgactaagtaagaaatacacagatgcctttctcagttgccccaagtttggaacccactccttataaaaatatatacaaagtacagaaattagaattcaataacatatggtccaaaaagttgtattccagagcaagggctaaggagggtcaagttttgggtaagttttgcagtggacaaaggatggtttcacaaagtttgaaaataagggaaaacatgcctagtctgctagctagggaacttcttgggtatcatatacctcttgccacccagagtagacataataaactgaatgtttctaaatccatataccttatctgtcctatcttttgatatacgacatggagggaaccctggaatatgaaaaagcaatactcattcttgtggtggcttttatgatttttattgaattactagcaagtatggcaactcactatcttgattctctttgcccccaaagggcattgacctgttcaggggatggaatcggggtcaacatgaaagaaaacatgcagagagacaactaacacattggaagtttaaaggttcaaagagaattctgcactcaataaaaaaacaggttaaaaataatcacaacagtaaaacatgaaaaatgtataataaataccaatgtgaagttccgaatttagtttcaaaaatttactcatagacatgctaagtaaagaagacttgtcttgatcaaagttcacgtcaaggtattcaagggtcctagatgaccatctgtcaggaaagtcacagcacttctgagcctgctttaataggaacattggacttagtaacctccagtattccttccaaatctgggaatgagttactccaatgagcctgtgactttctcaccttctgatttttgtggtttaacacattgttccaagtacataagaaagccgatttatatcagtcatgagtaatctatgctacatcaaactgcccttcacatttaaaaaattcaaacaattgaaattcattttttttaaaaaacatcatgtctcctttcacaaaatcttaaaagcaagtcagattgcctattcatttatcacaccagttagtcaatgattattataggtatcttccaatggagacttaaaaaaattatatttagcagatgtcttcacaaaggagcattttactggagaaccattttttagcattttgcaatattgaactgaaaatgactccattagctaatagcaaaataatcccattttcctcaaaggaaaaaaatatctttaatatatgtattgattaaaaggaaaatgccagtgtgtgggtcatttacgtatccaggaagatttaagaacctcttgaagaacttcaaaattatagtcataaactacttaaatgttcaacacgaactccttatacactaaatgaaaaagctaactggattatgttgcatttagaattttttaacctagaagctagcatgttgtggctcagaattgaatcattagctttgcattaattcccagaatcagggagaaaagaaatctttcttcagtaaattacttcttggggttgggggaactactgagagattgatctgagctttgttgcagcaagagcctcaagtcataaattattggcacacaagcagaagtcagtgtgtcatttctattgtagtcagatgcttttatatttccactcgtcaaggttgacttgatcatattgtacacctcctggatgtccgagacatagcattcatttgtccctctctttgagagcaggacaggtatttctttcacaacttaaacctctaagtttaagaaatatactccatagtatgactgtgggggtattctatgtgtgaaaaattttttcgagtgcagatttcaaaatttgaaattaaccaggttctcatttttgctctttgaggagtaatatgtattaaaatccattctgaggatctagcttttaaatgaccttttcagtactcatccttttgctcattttgatttgctcagataaattacaaccacctggccttttgtattaaaaaaggttacatacaaaattgaccttttgatacttattgagggaactaggttcattgtatttgagattaactgctgttgctgttttctgaatgatgtcttaaataactttacttgaggatggtaaagcctatttcttgtgccattttgttccaggctaattctaacaccataggaatggactgtctgagatatacaaagaaaattatgttttagaaaataatgaatctaatttattcagctcctgtgtgcctaatgatttacagatgtgatttcaatgtatcttaatcttgataaacccaatattatactttggccagtctgcccttcaccatattgcttattaagattctagcttctttctgtctgtttcttgaatattttaagctcaggcttgcctcaaaacttggtgcttgattttcccgctgcctgaaatgttctttttttttttttttttttttgagatggagtctcgctctgtcacctgggctagagtgcagtggtgcaatctcagcacactgcaatctccacatcccgggttaaagcgattgtcctccctcagcctcctgagtagctgggactacaggcgtgtgccactacgcccagctaatttttgtatttttagtagagacaggatttcaccatgtcagttggccagtatggtctccatctcttgacctcgtgatccacccacctcagcctcccaaagtgctgggattacaggcgtgagccacctcacccggcctgaaatgttcttttctagcttcctttgttccattcacctaatattctatttgccaccctacattttctggcttctgtgtaattaggttggactgtgtgactatttctgataatgagttgtatcacttgtgggctgaagcactgaaaagtccgtacacgattcactagtcctttttctgccatgattcttcgggaagttttgggttgagatggaaagtgacaagattgaaacaatctatatggctgatttcccaaatgggaagttacctagaccagaggattttgtgtgtgcaaaaaataaacttttctgtgttcaactactgagcttttgggaatgtgtgcctattctgattaactattcagggtttcagggcaaatgtcatttctcttctgtaaccattctatctaaagcactttccctctgcactgtatctttcctctgagcattttgtttcccatagcaatttttttccataatacttttatgtatttgtttatgtaagtcaacgtcgaacaaacaagacttctgtgtgctgttaattatgattcttaagtgcccagagtatttttaaagttgtcaataagcattcatttttcaacattttgttttaatgtcaacaagtacaaaaagcaagataaaatactatcttgcaaaggtccattgaatttcctgttggtcaccagaaaagatagcctgtatcaagccatagcacagtttttaagactctcctagataaatccattttgcattatttcttttatcctgaaatgagatcatctttggcaaagtctttataggtaatgctatctgtatcaacacagaaaagatttagagtccgtattttcattttaaaatttcccgaagagtcaccttcaaaaattctgcaatatttttgcatatatggaggtgttcgtccactaacgaatagctttgttgcttttaactccaggctacataagtacttcctccaatagcagactatactatctgccagctgcctgcttccagttttctggcacatggttcagaagagtctctggtattttttttgctggcatggagaagcttgctgaatagaatcaaaagagtcaccccatacatcagttactagaaaaagggcatgcagtaggagctcagtaaaaattcattcaattaattattacaggcaaatttattcaccatggaaatcttgatatgagcaaactatcacatttttctacaaataggcttttattttttaaaaacgatgaaagaaaaaaacaaaatttttcctagaattttagtctaagctattcaggatcatcctttggaatttgaagtaaagaacttcataatttgcttccagtccttaatggagtttcttgacaaggcattaagactttacagaaaaatattttcttattgctaatgcatgaagacatgtgccacatgaagtacagaacttcatttctcattaaggaacaaaatgagatatgtgatcaagtagaagataaaaacaagtatacacaggtatatcatctgcataatcaaagttttgcatggaatattcatcttcagtgttatgaagacttaagtgattttcttttgaaaaagtgttcacaagttggaattctttgttaatgagaagtcagcaagcacacagttgacaaaaaccagggattgtctatgctggatcatgttagtgtttcacttagactaaaaagaaatgatgaaattctaatcctttcctaatttacttcaaaatactcagtgttagcaaacattagaaatttctggaatggatgtgataattagatagggatattattttacttttctttgtttgctccatactgcaaattagcatgatcatccccccgccaccaaaaaatgattttaccaaggtctatccagagatacaaagcttaactgatttgattaacaactttgtgatatgcttcaagacacagcttttgtgttgagaaaaattcaaattttggtaaaattctatccacccccccacacactctttttttttttttttttgagatggagtcttgcttttttgccccaggctggagtgcagtggtggtcttggctcactgtatcctctgcctctcagattcaagccattctcctacttcaacctcctgagtagctgggattacaggtgtgcgccaccaggcctggatatattttttgtattttttagtagagacagagtttcgtcatgttggctaggctggccttgaacgcctgacctcaggtgatctgcccgccttggcctcccaaagtgctgggattataggtgtgagccactgcgtctggcccctatcccttttaaattaaatttattttcatgaagacttacaaatggacagatgtcaggcaacccttccattttcttgacttcaaaatttaattacaaagaatcgcccctgtaagaagtactgttttgtctcccatgatgtttaagtaggaatggatagcatggatatgtaaagataaggaagatttgctaatgaagattattcattttctctgacatttcctaaattaacctaaacaatgacagcccatgcttaaaaggaccatacttgtaaaagtaaggtatattttatttaattcctgtcagtagaaaccttttaaaaataccttattacaaggaaatgatggtgatgctatcaggtcatgtagtttgtaccaccctgctcttgttaatattgacaatttccagagttccatgagactgattttacattgaagttatgatctacaatcagtatgtaaggctgatatctttaagaaacaagatcattcagtatagagtataggtggcattgcatatacaccaaagtttacagaaaaaaacaaagtttgagaaccagtgagctacatgaagaaaacaaataaatgaaatgtttccaattaaatgtctgagctttgaactaattctgccttgaagatcattttcaaattcttatctagcaaataggaatgtgtcagtaattctaaagtagttttgctggcttttagaatttgttcccttttgttttaagcattaatatgagttgattgatttatttcttgaaataacttaaggaagtagagttacattttggttcaggatgaggggctgttagcttctgaagacagcagtaagttaatgattgaatccactgaaattgcagggaaataattaaagtatcatctattagtgccaggttcatagacttttccagtcctcatctatttgccctttagaggtctgtgatctgcagtttgaggaatctctggcctagaggttctgtgaggttcctgccaggtctaaaaatctgtggagattgtgtcttggtcatatgaattatataatcagtgttatccaggtgacaacaagaccctcatttgttgacataatttaatccgttattttgaccttttggtttaattttactttgagtgataacgtatttactttgatacgcatagtcatgcttatactttctacatacattgacatgcatatgtactatatatgcattggtatatacatatatataagcttattgtattagtcccttttcacactactgataaagacatacttgagactgggaagaaaaagaggtttaattggacttacaattccatatggctggggaggcctcagaatcatggtggggggccaaagcacttcttacatggcagcgttaagagaaaatgaagaagaatcagaagcagaaacccctggtaaacccatcagttctcatgagacttattcactatcatgagaataacacgggaaagaccagcccccatgattcagttcctcccactcggtccctcccacaacacgagagatttctgggagatacaattcaagttgagatttgggtggggacacagtcaaaccatatcacttatatatgctattaacattttagaggatattttgaaatctatattttaatcaaagatccagaaacattttccgtttttcctttgtctttcctctgtctggtagcagacctgatgacagtgaaaggtaggtttaggttttggcacattactgcccaaatagcaaccccaaataactgaacaacctacctggaaaatctgctgtggctatttgacaatattttgcttttgaataatgaagaaaaaataactaatcttaaggttttatggaatctcgcattattaaaggccttctggacagtcactcaagtttactttgcaagttaatacaaatattgcaaaaataccatttgacaaagaaatttcaaaaatcattggaaatgaatattatcagccaactcagtgaatacttgtcagtgttagacaggtagaattttttttttatttttaagttaacacattatgtcaaacacagcatattgccggcaggtcaaagattataaaagcctagaaaaaaaaataacaactgtaacctgaataaagatgtttttccaaaccactcccataatgactaacatcactatctaggaaaattaacctcacactggaagactgaaagcagaagatttccaatatttttctgaacaagaatttgaaccttgtgccttgaagatttagttatataaaatggtagaaaaccatgctttcctaatttaatgatactaaaagttcttgccacttctcttctttacaccatcctaacatcaaaagaacaaaaaatgattttttacttgtattactgtatgctaagtatgtttgtgttaataacagaaagcctcttatttcatgaattgttgcataatcttttcttcagaggctttattttagtttgtagctcaaaactaatgacaaaatcattttgagtgctctttttatacctttccaaattgttttgaatataattgctgttagaaatattaatgcattgtgatgactttatggcagtttttttctatgatctttgcagtattgccataagctagatgatgaggaacaatatgaaatctgatattgatttgcaagacaggtccacaaaacatccccattctaaaaaaataaatgtctacctactttcaaggagaagacataaattctagaacatcaaaggacatataagagttttaaaagtttatgcataattagagtcagttttatcataacttgcctttacccacatttggatgaaacagattcttatactatattttattcactcattcattgttcattcataaaacactgttgactatcaactaagtattgtggggaatgaaaaacaaaaataggcttttgccttaaagaagatcccagaaaagcatggagacataaagagatggtgccatattaatatcacaaataattcatagaagaggtgatcatttcaaagttgaggtgaggtagaaggacatttgaaggtggaggagagaatagatagggaacctatgcaaaagagtcatgtagtaggaggtatgaagacaattgcaggcagagttagtcactgctttgttttttatgtatgtgtatttttaaggagtattatcctaaagtcattcaaagagttgtatgccttgtggtgtttggaaaggtagctagtatcaagtttggggaatgataccgtatttgaagtaatagtattaagttgaagaattatctgtattcatatttgatagaatcactgactctacctggttgtcaaatttaagcgtagatattcttttcttttgtatttatttatttatttatttatttatttttgagacggagtttcgctcttgttacccaggctggagtgcaatgacgcaatctcagctcactgcaacctccacctcccgggttcaagtgattctcgtgtctcagcctcctgagtagctgggattacaggcatgtgccaccatgcctggctaatttatttttatttttattttttagcagagacaggatttcaccatgttggtcaggctggtcttgaactcctgacctcaggtgatccacctgcctcggcctcccaaagtgcttacaggcgtgagccgctgagcctggcctgattttcatatcatttttaattccatggtttgttttataagagattttgaatagcaaaacagttattatgtacaacaaataagatagtaacatctctttaatttttaaattttcttcacaacaatgtttatggcagtatgattataatctattgtattatgatcaatttgttcttttggctttattgttctgctgaataattggcaatagcagattagttataaaacagacacatctgctatatggcttcttatgggtatacaaaatgttaagcttcattttatataaaacacaatcctggaaaatctattaattttcaaattttcttaagaaaatacgatacagtttttcctaattttcaggatgagtttttatcattcttagtcacaaatggtggaaggcagttccaaatctaaattcattttaccacaataatgacagtttccaactgtctcataaatttgcaaaacatttgttaaaagggagactagtagagcaaaatgtgtcactgttgctgaagaaaatgggcctgtggtaattagtgtgccgtcttctgagacaaaaatagtgcttgaaatttaacattataattgtaccaattagcagttattgagtgctcacaatgtgccagcctctgtgtggaacagcccaagtgtgttatctctttagtctcaaccttatgacttaaagatactattgctattcccattttatggagagaaagaatgagtgaaaggtctcagtaattagattatgatccaattgctggtaagttcaacagctgggatttaaaacaggtcctctaaggtataggcgtagtgtaggtactgttattatttatagatgaaaaaaattgaggcttagagaggtctaaataatttggttaagctcaaacagctaaaaagtggagaaactggtatttaaaagtaggacaattgttaagaattaggggaggagggcagaaattagttgcaaagataatcacgatttactccatttgattattttagggctatcacactaaagcaagagtgctacgagggaaaatgatgttctcttcctaaatttcacagtaagaacatttgcattagtctcccaaaggcagaaactcagctgtttcagcaaggactctctaactagtcttctactaggtgacacagaataaatttatttgtctaattctttatttgtaactttactgacacactatattgtgccctaattatttccattttaccagatttgctttacaaactatagtagtaaagtcctgggcaagaagaatatttttcttgttctttacataaagtaatttagtaggcattcagttcttaaaaactgatagaaacacaaagctcaggaaacaaactagaatttttaaatatactttcgcattctacaaatttaaaaattgaacaaaagtatcagtcactgatttttttatgagtttttgggagtcacaataatagattacagtccatggaactctattttttgtcaacgattgtgagtttggaatatttgttgatttatattacaatatgtgatattgagtattcattaattctattttgtagaccttatacttttagatataaggaaaaggcaagatgaggaaaaagaagctgttcattttgtctagcaatcacttgtcatatgagatgccgtttatatgctgaggagaacaaatacaaatggagataattgataatacaaatcttagaaaattgtgttcaaacacaaagtggaatttacaattttctcaagactttttgtacatgagtataggaagggtagattgtatatttgtgtgtgttgtctgggcatgttggtgtgtgtgtttttaccaaagacgaagaacctggtgtcttctgcatttactatccttagcatttgagataacattatgtttgcattttgcatagacatactattcagatcaatttcccattcctattgagagaggcataaaccagattctatttgccaggagctgtatttttaataatataattttgaagttatattaaagtgaataatttgataattcagatcacattcactttttactttgaatatgtatttttaaaatgaatttgttacttcaaaaaaatgtgatctacaaacttaaattgttacttattaacagttgcattatttctatcccatattgtcatgtgaatgttctctttttaataataaaaaccaggtattaaaacaaacattttaaataataaactgtcatggcagtttattatttaaacttctgcttaaataaataaacttgtgtttaaataatttggcctgtgttcctttatcatctacaagggaattttatgaatcttcactcacaggactacatccatttacattcaaagactagtagttaacattttaagtaaatgacagagaatctttaaaaatatctgtgaataatgaagccattcattgtgttcaaggattttgcctttcttcaataatacaattttcttctcattttaaagagtatttaattgcatcacacgtcctattttaatatttaataataattttattagctgtatagaatgagaagggcaagaattgcaatatctagtgctggtcatcaatttttttatcatgacttaatgaatatcataattacaaggagaggcaaaaagataaattagcttagtagttggttgggacttgctagtttattggttttagcctgggcacagcccagaatagtcacaaagagaaagaaacaagtatctgggggtgctgtagaagtccttgcacacaatttctgcaccttactaatcatgcctcattttgaatgataaacagaggctttgaacaaaattataaacactgccaataataattccttctggttccatagcagttcacaggggattctgatgacttacaaaacttagtcttggcaggtatatgttcctttaatttctattaatgcattttgacaacttttcattatcttttcttaaatatttttactgttttttttttttctttttcagctaagacaaaaatctgagttattttgagtaggaaaatttggcatagccatcactgtaataacactttttactcaagtagcacctctcacccgaggctttcagagtgcttttgagtacattgtattaggcctgcaggatggaggtcaggggaaaagttatttgtaggcaccgtacatttaaagcttctgtggacatacagccaaggccacggggagaaagtaattttcatctttagtattctagatatggatatctgtataaaatgattcctaacttttcaatgccatttgttaaaagagggaaccagatattgttgaatttcatgtgcttttaaacctattttaagataaatcatttttaaccccctccagcaactgcttcgagaacgacagcagatggccagccgtccctttgcttctgttgatgtagctctggaagtgggagctgaacaaacagagtttctgcgagggccattagaggtaggaacagcggtgctgaaagaggaccactgtgctttgcatatttattatattgcttctctaatctacatctgcttatgaagccaaacagagtctgattatctacagttgacaagattcagctacatatgttatgccattttcaaggcacatagttttaatagtatgacatgagctgtaaccaaagccactggagaatctattagcctaggcaggagtgacagactgctcacctggcagcctttctctgacagaggagctgagggaatttaagatataggtatgatcgaagaaacaaagcgcctatatttagtctttggagtactctgtgcaccaagttaacaattcacatctatctttattaacaaagtttacttagaaaaggtacgagtggagatgagttgcattttaattacatagcttcatttttgaatgttgaaaagtgaatgtttctcacatataaaatgaatatttttatttgtggttaattgctgtattattacattcctttattgcaaaggcagaaatagagtatgatgaaacagaaatcattatatgcaactaaatatggtattagaatccaaaagtaatacatgaagtggtttctgaaaataataatccctaaagatgcaaaattcggccgggcgcggtggctcacacctgcaatcccagcactttgggaggccaaggtgggcagatcacgaggtcaggagatcgcgaccatcctggctaacatggtgaaaccccgtctctactaaaaaaaaaaaaaaaagaaaaaaaaaaaaaaaaattagccgggcgtggtggcaggcacctgtggtcccagctgctcaggagactgaggcagaagaatggcgtgaacccgggaggcggagcttgcagtgagccgagatcctgccactgcactccagcctgggcgacagacagagtgggactccgcctcaaaaaaaaaaaaaaaaaaaaaaaaaggatgcaaaattcacaaattatgattaatgactattcaaagcattatgatgcatactaatttaattgtatgtttattacttttatttacttttatatgtggtaagatatatttaagtagaaaggttaagaaactctagaattgaaacattttattctcttttttaaaaatgtctttatttgactaattttatgttgccattttcagattttactttttgtcaaggaaaataaagaatggaaaaatagaatcattcaaaaacctaggtatacatataatagattctgtctgtagcatttttgttttttctgaaaaaataagacaaaatcacaactcatggatgctactcaaagggtcagtttttagaggaaatgaaatattgggtgcatgtttccctatgatttttaagacattttgtgtacttgattttttactactctagatcacaggttaccatggaagcttagaacatcaggaaatttgtgtgtatatcttctatttgttggggaaaaaataacaaaaaagaatgattaaatgaaagttacagcaagtgctctaatttcattttggttccttgtttcaaataacttttataaaaaactttcacacacagaaaacttagactatttttggactattataaattctttttatccccatctgtttaaaacattcttaaatactgctaaaaatcgagtaacaagagaaaaaaaatgtaagtaatgcacacatagactaaagaagaaaagaaataaagaactagaaaattcacaaactcaaggaacaaatatgacacagacatatgtcaccatagtttgtcagttgcacgttaatagtgttcaataatgtattgttaggtacccatgtgttcataatcatcatatcttcatgttctattttttccaaatgttggttctttctttatcattgtgaatttttaaccttaaattgtattttgtagagttaaaaaatgtctagccctactttcttttagtccatattttctgatattccttatttcatttgcaatttcgctatatccttttgttttacaactatactttctggaaaaaactgttagcttttttattttttcatttactctgttttttattgatgttaacactgacattaactactgttctaccaaggcttatttcagctaccccattttgtgtgtgtgtgtgtgtgtgtgtgtgtgtgtgtgtgtgtgttgttactagccttgcttctttttgtttttttttcccagcttctgtccataaactgattttcatctactaaacagaatattgcatattctatttttatgttgcttatagctaccctttccttatcaagattcatagtgatttttccctagctatgctttaatcttattaaaacatattcctccattgcccatctcaaataaaattaatactttagcatgctctcaacttccctctgtttctccttccatatgttaataccacctggaatttttatcaaaacgttatggatgtacttctttctttattatggcctatgtaaagaacaatgaactttatttgttctcctttacttttgatatctagttgtttgctcatgcatttcttttatttttcactaagattacctctctaaaagatttttttcaaagagaaactttgggtccagcatggtggctcactcctgtaatcccagcactttgggaggccgaggtgggtagatcatttgaggttaggagttcaagacctgtctggccaatatggtgaaacgccatctctactgaaaatacaaaaattagctgggcatggtggtgcacgcctgtaatcccagttactctggaatatgaggcaggagaattgcttgaacccaggagatggaagttgcagtgagccaagattgcaccactgcactccagcctgggcaacagagtaggactcctcaaaaaaaaaaaaaaaaaaaaaaaaaaaaagagagagagagagaaactttgtatggcattatctttgagaacctaaatgcctaccaatatgtttttctcacatgtacaaaacagtttaattgaatatgaaattttaggttcaaagttctcttctccacagctttaaccattgtctcaagtctgatgtcaatttgattttttgtcctttgtaaatgatctccattttctttttggaatttttcagtattttctcctttctcagtgttcatacatttttctccaatgtgtccatatgtgtgtgtatgtgtatatatacatatgtttcttatttcttcccaagtaataaaagatacacgtaaatttacgtatttgctagatcggcagttgaggcgggaagaagtgaatgtttagggttatctagccatctgcttttatagctatgggatttcttccctgagatgagccctataattaccctgtcatcagtgtattagtcagggttctatagagggacagaactaataggagatatatagttgtgtatatgtatatattctatatatataggagtttattaagtattaccttacatgattacaaggtcccacaataggccatctgcaggctgaggagcaaggagagccagtccaagtcccaaaactgaagaacttggagtccagtgttcgagggcaggaagcatccagcatgggagaaagatggactaggccagtctagtcttttcgtgtttttttctgcctgctttatattctagtctcgctggcagatgattggatggtgcccacccagaataagggtgggcctgcctttcccagcccactgactcaaatgttaatcttctttggcacatcgtcgcagacacacccaggatccatacattgcatccttcaatgcaatcaagttgacactcagtattaaccgtcacaatcagtctccagccttaggctggcacttgactggttctgctgctttcctgccccacagcaggtgggatcggtaccaatctatccaggacaatgtggactgtggcccatattatctccatgtttaaaatcaggagagggaacaaatgactcattctgatttgctattttgttgtctgtggggtcatttttgcaagtacttggtataacataaagcattatattaattgttgcaattcttactatttttatttttcactcagttctcttaataactagcatgcctctatttcttttgtatgactttttgcagaaaaataattacatgtaaattctcgtttaggaaaggcctttatatttggggatcaagatctagttattaatgtatggtatttttatggaaatagctttattgaaatatagaacatataccaatagttattatatttatatttaatatatataatgttctaatatttaatatatataatgcactgatttttggtatatatacagttatgtaaccaccaccaaagtcaattttggatcctgtcatcaccccgaaagaaaccctatgcctttcagcagtctccctaccccacatttttcttcagcccctgcccccccaccccacacccatctcctagccctgggcaacgattaatctaccatctttacagattttactgttttggacatttcatacaaataaaactatatacagtgtgatcttttgtgattagcttctttcgcttagcataatgtctttaaagttgatacgtgttgtagcgcctgttagtgcttcattcatttctattgtcaaatgatattccattgtatggatgtggcacagtttgtttgtacattaattagttgatggttatttgagttgttttcaccttttggatactatgaatgatgccactgtgaacatttgtgtaaaaaaaattgtataaacatgtttacatttttttgggtatatgcctaagggtggaattgctggattatatcgtaactttttaccgcttgttgaaaagtactttctttctccattgaatagtctagggacccttgttgaaaatcaatttaccataaccatgaggatttatttctggaatctcaatattattctaccaatctatttatctattcttatgacagtaccacactatcttgatgactctacctttgtagcaagttttggaatctaaaagtgtgagtcatccaactttgttctttttaaagactgttttaaagattgaatttcaacttcctaggtcttgggaatgatcaaaatgtttaaattgaggttaaaacattatttttcaaaattcctttacatacactatctcaatctcatttgagtcttaagtcaatcctataaaataagcagaacatatttcatcttttttttctatttactattgaggaaactgaggctctgagagcttcagacctatgctgaagatcacaaattcagtcaccagtagagcaagaaccagggttcaaatctcatattggcctaagggtttctttcccacattgctttttatatatgctgattttcgttcaaattgagaagacatcttagaccttaatatatctatagaattttttttgtaaggaatagagttacttaaagttcatgtagtatactttgattccaggtgctcaaatagtcatagataattgtggatcttaaggaagaactttcacttggaaagttataggctgtcttagtatatcagagaattccagcagttatccattgtaatctaaattgctataaagaaatcaaagtgacttactaaactgcaataaactcagcacacaagctttcttttatttttatattagaagtttcttataaaaataacttttgtagttttgttatgctaataaagtaacagttctgtagaaacaaagtaatttaagattgtttatttggtaattatagtcaagtaggctaattaataattttaaagacagttgtttacagcatgattaatttttaccagactaattatttcattagtattctctgtatatattttaactactttataccagaattttcattttacaaatttgtaatgttttgattctctccacctataaagaaaattatagctttcgagtactataaagtggagttttcaaaaagacactggacatgtaagaagcatacggtaacctagaaaaaattaatttcgaatctactttctatttggtagctctaacagtgctaattttgacatcacattgaagttcattctctgtttattgggacagttcagcctcgtatcttatgtaagaaacctcgctcccaaggtgaaaaacgcattgttcaagtctaaggcagtcaaagtgaagcagctgtcctattaagagcattgatggcctcattcctggaccacattaagcccagtcctctgctcttgggcacagccagtggtccccctggttcctcattcctgtcctgccatatccatggacagtagttccagtgactggcctaagcagcttatttaattttccccaggtttccttttttcttatagctgatttgtgatatttgatatttttaattattatcatttactgttaatattctgattatgtaaagaatacatcctcattatagataaatattaatgtaaaagatataatacaaattaaaatatttcattatcccattacccataaatattcagtgccagaacttttatttctttccaataacattttcattttgcatatttgtatttttacaaaattgagagcatattttatagtgattttgcattctgtttttctcagtattagaataagaacatttttcacatctaagtttgattcaaaaatacattttaattattttgtggtatatcatcatttatttgcctattctgttttcaattagcattattctaatttcacactattataaataagactgcatttcatttttgtatataactcgatcttactttatgaaaaaaaacctactgaatcaaaagttattaagttttaggatcttgaggtatattgcttatttactttctagaaatgtcgctgttcacactatctttagcaaagtatgagaatttctattttcatgcatccttgtcaaaaatgattgttggtgtttttgcaactgttaatttgatacaataaatgttaccttctttcttttaatcaaatttttattgttagtaaaattgaatatttttgtattgtctgtaaccatttgtatttttcctagatgttcatttgttgatcattattctctaatccttttctattttaatagcatttattgatagtcatctgattatatgagaaatattgtattaattctagaaaacttagaaatgatagctcattcgatatctttcttcatctttctattggaacattccttgcctttttacttctagatcaaatatattaagcatttgtaaattacctgctataaatgttttctctctttggatattgattttaaatgctatattttctctacttttaattaatcagcttattgtgtcttttggtaatatttttcagaccctacctttgctttattttcatcctgaatttcctattatttttccatctttaaaaaatattcccttttatcctcaattgatttgcatgttataaaatttatttattttagtggttactcttaacattttaacaggcatagtttaagtcaaaaattaatgaacatttttccctcttcccaaacaatataaatcttgcttccaatttaagaacaatttaaatcttgcttccaattttctttgtttttgttacctttgttaagttctatgagttttgtcattccttgaattaaacattattgttgttgtattatatgatcaatatgtgtttaaatttacttacatattgtgtattttcttggctcacagttgttcttcgccttcagagcttccttttaaaatgtttctactttcctgctctgtctttaagtaatgcctttagcatatgtcttttgataataaactctcttacgtctttctatttccctctccagtttcagtatcctcttattgtttacaatctaagaaatgtatttaaaatatactttatcaagcattctagttatctttcagtgggagggtcacactcacacattgtgttcacgtgaaaattgttctgacactggcttctgatttccgttgttgctgtagtaggtcccttcatatccccagggaatatgttccaagagtccccgtggatgcctgaaatatgggatagtaccaaaccgagatatacatacctatgataaagtgtaatttgtaaattaggcacaataagagattaacagccgtaactgataataaaatagaacaatattaataacttgccagcatcactactcttgcactttggggccattattaaataaaataagggtacttgaacacaagtactatgatactacaaagctgatgtgataaccaagacagctactaagtgatgaatgggcaagtaatttatacagtgtagatgcaggctgaatatgctagacagagataattcgcatcttgttccaagtcagaattatgtgcaatttaatctttttcttctggaatttttccatttaatattttcagaccacagttgactacagataactgaaaccatggaaagtgaacccatgcataagggaagactactgtactaaaaactttccttcagtatcattgtcactcctttatagagaatctagcttttctctccaaaatccctgtgtttggtgttcagcagttttatcacaatttaacaaagtatacctttatttgtttttaacctacttggcatattttgtgcttcctatatttgaggatccaagtctttggttatttctaagttattgagtcattatcccatttgtattttctttattccccttctaagactctgattagatgcgtgttaaacctctttccatcttcacaatctcttagtctttctgttttgttttctatctccttctcaatgctgtttcttttggcttattccgaacattgttccaattcactaactattttaagtgtataaaatctgtttttgacctgctttctactatgtccatttggattactatcaacacatatttttattactttctaaagttatattttattatttatttattaaagttctatttggttctttttttaaatctgacagtttttgaaagtctcttcttccttactgttttcattacttcatttttcattccgaataaaattatttttacgttgtatctgatcatttcaatatctgaaatccttggaaatctaaatctgttgattatttctgctggccctcaatcattatgactgatttccttgtgtatttggtgatctttatgagctcttatatgatcttagtttgtggtttgctagtgacccaaagaatgctttcctgcatagaggattgcttttgccaaaaaccaagggcctctctttattctgtagtcacttcttccagggtctctggaatagtgcaggaatctcaaactcagttttcctttttatttatttattatttttttgagacggcgtcttgctctgtcgcccaggctggagtgcagtggcatgatctcagctcactacaacctctgcctcgcaggttcaggtgattctcctgcctcagcctcccgagtagctgggactacaggtgtgtgcctccatgcctggctaatttttgtattttcaaactcagttttcttaccgtgtgagttgctcatattaacttttaccctcagggccactctgctgtcatatttgcttgctgctcattgcaccctctccagttttatctggttgccttggagcagttttatctggttgccttggagcattcccttactggctgcattctcagcaatgcattaaaaggtatacttcattgggtaggcacggtggctcatgcttgtaatcacagcactttgggaggcctaggcaggaggattccttaagcttaggaggtcaaaatccacctgagcaacatggcaaaaccctgtctctacaaaacatcccccccccccaaaaaaaaaggctgggcatggtggcatgcatctatggttcagctactcaggagtctgaggtgggagaagtgcatgagcccgggagttcgaggctgcagtgagccatgatcatacactgcactccagcctggttgaacagagcaagaccctgtctaaaaaaaaaaaaagaaaagtatacttcattaagcatttggttattttgaagtgggaaggccctacttacactatctgtagttgtctcctctggcaactctattttactgaacacaggttctctttggattgccattcctcctcctggccttggctcgatattttcattgtcaccaatttaagactcaggctttggcaagttgaaagggatgggaagggaggtccccttcacttgttaatgtggtagtagcatagaaacagtcaagccatccatttcctacagaccttttggtactcccccagtttcagagagaatgaggactcagacccccaattctgcttctttctaagcctcttggggaccagagagtccaggtatagtcttttaggaactgtattgacttttctcttggtgtttacagttctctctagaccaagcctctgtaaaattcttacactgggtcttgatgctggttcctatgcacttggccagtccaaatgggagaaagtaaggcatgagttccctccaccagagtttctataggacccaatccctaattgcacatagttgcctataggccccatgagccatttgccttaagagagggagatgattttcagttggtagtagacagaaggaaattgtaaggaaattgccaaattcttcataaaaaatgatttagaagataatgattttttttttttttttttttttttttttttgagatggagtcctgctctgtcgcccaggctggagtgcactggcacgatctcggctcactgcaacctctgcctcccagattcaggcaattctcctgcctcagccccagtctgtagctggggttatagacacccactacaatgcccagctaatttttatatgtttagtagagacagggtttgaccatgttggccaggctggtcttgaactcccgacctcaggtaatccacctgcctcgacctcccaaagtgctgggattacaggcatgagctgccatgcccagccatgattttttattttaagaaaattatttacaataaataagagatttttataggcacacctttggttcttgaagtgaggaaagatctagtttcccagctgcattttggaattttcttcatctttatgttaaaattataaaaagacctttcttcaccaaaaccatttagcaggcaatgttttggaaaaaatgttttggaaatgtcagatttgtagtattaacataaacatcgtgagtttcatgattgattgaagcatgaaataagaattaagtaatggtgcttcttcaatattaacatgatataaatagaactattaaaaaggtatgaatataatgtattactgaaattattgaaatctacatggttttaagttaatataatctgaactttaagcatgataaaagtcatttgtttacagtttaaataaataatttgataaatgccctaggttaactgtcctaataaagtaaattactgctatcatctttcattcagaattcactgagtcaaaagctaaatatatatatttataattattgtatacatccaaaattaaaattttacaaatgaaatttttcattgcactattgaaatattatttttatcttatcttaaatcatttaagatgaatataagctatgatggagaaaaatgtaaagatgaaaatgaacaacagcaacaacaaaaaactggtttctcttcactgtgtctgacataataaatagaaacatttggatgtacaaaaggcttatagtcctgatcaaccttattcatactggctgccattcaagagaataatgtattatttaagcatatggtcacatcacagctgaatcaatctagcataaactatttttatacagcatccttgcaagtaagaaatggctatgtaaagtaagactataatatcctttattggaaagttataaatacagtttaacaatgcttgggaacagtgttatagctttggataaacaagactgaattgccaacactgtcctccacccttcacctactgtcagataaaagaggtaacatattgaatccaccaaaaataactgtgctcaacagaatgggcagattgtatctcctgcacccaagaacattccacaatctatgaaacacagtagggtaaatttgagtattgtcaaaccctttgaatactcattcctatgtatgttaaaatgattgtgtttaaaacattaacacaaaagtagtattaacatcctaattaatacaactttctcagtaacagcaatcagctagtcatatttttggctcctgtttctaaccttttagattgtcgtgaagcattcattttatgtctggtagtatgcagtagttatttcctagtttttgtttaaatattttattaggctgttattgcctatgacagttacttttacactaaatttatgattttgcttaatatattttttgcttatgtttcatataaaatcagttactaatttaacttgtatatccttttttctgttacacgcagtaggagataatctcatcaggtttatatcctcaatggaatagctgactgtaagaatccttaaaatgctgttaaatcaaatagaatcttatgaagtgaaataccagatattcaaaatgtaaagctagatattttatgtgtagaatctaagaaaccaataatgttatactttagataaacattttcatgtgttcccatattttacttccttagaaaataaaatagcaactaggtcaaaatttagagtattaaatatgcaaatttacctcaaatcttaatatagattttttttcatcaaaggtcatagttcttacatatttcataccagagaccttttcttatattcacacttgataattttgtttatattattatatgtctttttaaatttgctttatagagaaaggctctggatttaccattaatgacatataaaagtggggcagaaagttgggtgcagcagcacacacctatagtcccagctacttgtgaggctgaggtgggaggatcatatgaggccagaagttccaggccaggctgagcaatatcaagatcctatctatctatctatctattttgtttttttgagacggagtcttgctctgtcccaggctggagtgcagtggcacaatcttggctcactgcaacctccacctcccgggttcatgcaattcttctgcctccgcctcttgagtagctgggaatacaggcacacaccaccatgccttgctaatttttgtatttttagtagagatggtgattcaccatgttggccaggctggcctcaaactcctaacctcaagtgatctacctgccttagcctcccagagtgctgggattacaggtgtgagccaccacacccggccaatcctatctctttaaacacacacacacacacacacacacacacacacaaacacacacacaatgttatggaatagactatcaagtatgtaaagtttaagtgcaattttttatgaaggagtttttatttcttgatttttttactcatcccagcacattttggaaaataaaagtaataacagctcagttttatttttccatattttaaactggaaattctaccttaaaaacaaactctatatactatgaacaattgtctccacaaatattgacctatatgcaaagcaatacaggaggtagatatggaaaatatgttatctttacctttcagaaacttacagactaacaagagagatatgtgcgtgtaaaaatacctctaataaaaatatgttattaatgccaaaaggacaataagcatgaagaagaggaaaaaggaatacaatactcaatgtattgctgaatgtttcaggaaaggttgtggtcatttatcttgggctttaaaggtacctaaaatgtcagtaggcagagataggaataggtgaggatggagacaggtaagaagcatgccaagttgagagagcaaggtgagcgagggacggagacagaaaacagggtggtatgtgagtgaggcagtgagaaggccacattcacccaatgaggaagcagctgtgagagttaaggtagcaaatataggagcatatcatggaagacaatttaaacaagatgccgaggatcacacagaaggtttttgagaagagttttatgattaattttagaaagattacactggcagcattttctagcatcaactggattgaagaataattgaggtagagaaacaatttggaagggcaggcgctgaactagtgattgtcaaaatgttaaggtgcaaatattactgaaaactttgacaatgtagaatatatagaatgtaagtaactgaatatagggatagtctgggtcaaaaagagggaggggtcagaaggttgggtcttcttcatatgtacttgaactcatgggagtgagaaaagagaattgaaggtagaatctaggaaaattgctacaaagaaacaaagattcaaatgacaggctgagaaagagtacagaattaagaagattgaagagttttagaactattagaattaagaataagactgcatgccaagaaggatggtgtggtaaaatatgtcatccatttcaaagcagtcaatgaagataagcactaggagaaaagatggaatttggtaattatgcagtcattggtggcttttgaggaagtaatttctattaaatggcagaagccagaccgcaagagatgtgtgaagatgagaaagtggatgcaacaaggatagatgacccattttgaaactgacaatattgaaaggaaggaaggacatgagatagtaatttaagaaattggcagtttcaagagaaagtttttttggggaagaaatattcaagggaaaaaatgtatagtaggataaaggggaggtgaaagcagagaaaggatcaagaagtcaagtagaagtattaattttagaaagatgaaaaaggataataaaattatgggtaaagatgaaagtacattttgagcctttctatttgataggagtttaccttcgatgatcttataatttttcacgataattgagaagtaaggtcacctgcagagagtgaacttgatgtacaaggttgaggcttaagaatagtaagagatgtagaacatttgtttcaaaggctatgatggttaagacaaaaactgagttatccatctcctttcactctattcttcattttctatctgtcattgagctctgcctgttctacagcctaagtatatcttaaatgaatctctttatcatcactactgcccctgtttcaagccttcatgatttttttcctgctctgttacattatcttccttactggtttccctgccttcactcttccaggcagttttccacattgctactaaagtaatctttctagcatgcaaatcttctcatatcaccttgctcagaattccccaatggcttctctattagtccattctcacactgctaataaagacataccccagactgggtaatttacaaaggaaagaggtttaattgactcacagttcagcatggctggggaggcttcaggaaagttacaatgaaggaggaaggggaagcaaatatgtccttctccacatggcagcaggaaggagaagtgccgagtaaaaggggaaaagtcccttataaagccatcacatctcatgagaactcactcactatcatgagaacagcatagaggtaaccactccatgattcagttgcctcccaccaggtgcttcccaggacaccacacatggggattacgggaactacaattcaagatgagatttgggtggggagacagacaaaccatattagcttcctatctcttatagtaaaaaaaaaaaaaaaaatacaactcttctatataatgtactatataccctacatggatctgatactaccattcctatccagccatttcttgtcatttcaccccaataagctgactccacacaacatccctgcccttgcctctgactctgtctctgttgttctcttgtcctagaggaaattgcctaaagtggtagtttaactaattcttaaagttcgaaacaaaagaaagaaataataaagaaaaaatgaatgagaaacattatcttaaggtgataaaaaggattgctgagcaacagtgaagcattgaggatatagaaattatgtaggagcacagtccctattcttgtgaataacagttcaagtagaagtgaaagggaaaactgatgtttaagatcttaaaaaatatttgagttacaaagtaattaggactgcctgattttgctttatttattgattattctcaattagatagatctgtgttttaattgctcaattatgcaactttcttattgtattttaatgcattaaaatactatgtgtattttattaaaattgtatgtgtattaaaatacacatacagtaactcagacttaaaaaaataacaaaaagaactttgtttagaaaaaatatagattttaagtgaacaggaaaaatctttttgtaaccacattgaaagaagttgttcagccagtatattgtacacatctacacatatgtttttattctaggagtaaatataaatgaatatgtattcaacatgaataaatgtgagtaaatattgagtattaatgaacttacataaattttttgcttataacttcctgttagaagaagcattctttcaaaacttttaaaaatgtattgcatatgtggcctcttaaatgtctttgaaagatacatcataacatctatgtgtttggaggaattttagaaatttttagaaactacgttcacaaaatagaatgattatgcctatataaattaaatttcaagcagttccaaataacattttattaaaagtacattaaattttgatgacctcattcattaagcaaaataatgtacagtgctctatactagacattccagatagcacaaaagtgcttatgacataattgatactctagaatatcttagaatctgctgttaaggatgacattaattatatcaccccttgaatcatctctttcttcttctgctactgcttcttctttcattctctttcagtctagttctcttactacacactatttctcatgtgttacaataacatgcaaatgatgataaacccaaagcaccataggatctcagaatacttttaattcatctaagtaagtttaatgttagtataattagtaataaagatatttcattatatttacattaatatataaaccctctttttgccataatatttgattaactatatacctctaatcagcctcccactgtattgaatttaatgtgagtgtatgaatatgtaaatgcacgcataatacatatacacagttttcatccagcactgaacgacaatgtgattgtcacaataattattttcctacatattcttgaattgtgagggcaatatagttataacatcagttgttaatttttaaataatgttagctatttctctaagaaaagtaatatatcttaattgtaaaattttgtaaaatgcagaaaaatatattatacaaataagaagcctcattcatactccatcactgtttgttctacaagtgtgtgcagtcatacagtgaccacaccaatcaagatatacaatgtgctcatcaccatggaaagcaaagcccatcactctgccccaagacccttagaaccacttatttgtgcctttatagttttgcctttcccagaacatcatgaaaatggaactttttttttttgtgaccgagtctcactctgttgccaggctggagtgcagtggcaagatcttggctcactgcaacctccgcctcccggggaaccatattttatgcagacttctgtgtcttgtttctttcacttagcacaatactttcaatgagctccaaccatgccattacgtatcagtagtttattctattactaagtttattccattgtatatccaccacagtttatttatccagtcaccagatagtagacatttgtatttttcaggacctggagctactgtaaataaagctatcattaatgtttgcatacaggtctttctaataaaatatgtttttatttctctcaggtaaaaagctatcagtaggatttctgggccatatggtaaaagtatgtttaactttagcaattttccaaagtgtatatgccatttcgtatttctccccacaacacatgagagtttcagttgcttcacaacctcaccagaactaggtattgttgagattttgtattttgttttgttattctaatgactgtgtgatggtatcttgttgtattagattggtgcagatgtaatggcaaaaactgcaattacttttgcaccaacccaaaatttggttttgaagagacgtaaattaatttccaacattggtggggtctggctacccatttataggtatgcatatcttcaaacgttagttttcccatagctatatatgcatagatatcaactgaggaatattctgtaatgaaatactaggggtggggaatatgtaatatgtgcttaaaaaacaagaatccaaaaattgaattttggaaaatatcttcataaaataaacagttgtatatttccagttcttatgaggccttcttagtgaaataactccattatataagaaaagaaatattaatatcaaaggttaatttttaacttttataagaaaaaactgagtgtacatagaaatagagagataagtcatatcactcaacttcgagaactgctgactcatggccaatcttgtttcatctttatgctctctcaccccgaacttcagcattgattattttgaagcaaatcccaggcatcaaagattaacttttaattgaatctcagagtttttgatttatcatattagtattgaaaataattatcttaaaatgtttaaatttttaaacttttagtattaatccctaaggttttagtagtctcttgatttgacccatttacatgtggagtatttactaggtatgatattccaggcatttattcaataagcaataggaaaatcattatacctgaatgggaataaaagcttattaagtgagattgttttactttattagcatactttgtatatagtttctttgatagcattttatagacattaaattatatgaactgtaggttttgcataatggaagttgccacttaacaatattggcccctattttttattcactataatatatttttgagttacacattgactataatcctaggagtactttcttaattcttatattataatactgatctaatttttctcactgggaagctcagctgaagtgcataacaggttttaattaagaataaaaggaggaaagaaaacaaaacttcacatcattaggaattctgatttctgctgctctaacaaaaaagaccacaagcaatatgagattcatcaaatgtgagaaatgataactaaccatgttaggggtcacctataacaaactacaataattgagaaagtaaccttgacgcatttcagttgaagtgtgagtatctgtagtttattatattccagacagtatacattaccaaagatgtagggccaaattaactttaatgttgcactcttcacaagacattccatagctagcaataacattaagataacgctgttaaagtaagaatttcaattataaggcagatgagattgtgaaaacatgacagctttaatgagcaatagtagttgggattactttgataaggaatatagttatcatagatagaaaagaaacaaaatacagcctgcagccttttcttattgtgtcatgtcaccctctattgataacagctttgggttccaattcatttctattcattctcccaacctgtgctagaatgatgatcctttatcttacatatactgttagaacaccttccaattctgcattccttcattcttccaaatagctgatagcatgttatcttacttgctctcatcacatcttggttaagaaagaaaggcaatcaagatattggccccatcttgcaggtgggaaaactggatcgataactcagtggtaatactgggaatagattcagattacttgaaagatcaccaaatgcttattcaggaggctgactttaaccaaggaatatgtaatgaatagaacccaaatacagtatcattctttgtggttgtatgagacatgctcttgtttttgaatttagagtggtagagagagacatgatcttgtttttcactctggaatgacagccttcttttcctctgatcttattgttcccaccagtgatcttcactattccaactagtgagaggtgtgttattccatctggactgctacaacaaaaataccataaacttctgttgacttataaacaacagaaatttatttcttacaatttcagggactggtaagttcaagatcaaggcactggcacattcagtatctggtgagggcccaactttcgggttcataaatagtgccttcttgctgtatcctcttatggtgaaagatgcaaacacactccattggccttctttcataaggacactaatctcattcttgagagtctggctcttataacctaattacatcccaaagacttcacctgataacaccaggactttgtagattagatttcatatgaatttgggggaggatacaaacattcagaccatagcaagagcgacatattctttgttgcccctaagcatgtaaccattcctacagtggttgtatctactggccttgctagtgaagcctgtaagtcatgtagaatgtactgctattgcttttctgatattatttaacaaagaaacctactcccagggcagccagcaatgttgacaacattttgacctctcctgaagcttccaggctgttttatacaatgaaggaagggtaacaggtcatcatgcttatctgatctataattcatttgattaatgttactgatcagctgcatcttttttttttttttttgcctctctgttgtaaattggtagggattgtagtttcttgttcactttggatttttccattacacatgcaaatggagatttttctttacataaataaatctttatgatcattttggttatttttaaaggtctggaacttttttctgtctctgaaagccctggacactcttttggtttcaatcaccctatgctgtatgtcactatttactcaccatttatataattaatataaatatttttcctcaatttctttttaaatacatttctcataaaacattttcacccacattgcttgctctagagcatgaccaatgttcatagtctttgctacaatatgttgtagaataccataatgtttgtgctgtctactctcatatttacttaatctgtcatcaaagggagcattgccgatgcctttaagtgaaccaatcgattatacagcattatgtttagcttccatagcagcaattttgttttctcccttaggaatcttaattctggaaatgaacattttatctagattcggaatgcttatttattaaatgcaaatgtatttagcttaaataatatatttataatgattcacagtaacaatgaaatgtataagacattttactagagtctatgatgattttcaatataatcacaatgaaatgtatttaaattaaaaatattactgtaaatctctcaagatgaaccacagagctcaatacaaaattgatgttcttaagttaatcagttagttaatgtattgccaaacaaactagaatagaatactatattatcagggcaactttgttaaatagatattcaactttttaaatataagaacatagtgtatttcaaccatcttttaatactaattttatgtatttttattgtacttattttgttttatttctttatcattagaaacagtaaaccaataattccaaaacaaagaaaactcactaattctttttattcttgttcattcctttttgtcctgttaatcgtacttagaaatacagtattgacatttcctgggctgcttttgtgtagagccttgtgctgatatataaacatagaaatttatacatagttttcattatatattagtaaaaaaataagtgaagtagaaaaacgggtaaaagacgtgtacagtaaagatgctgaacaaaaactcacgtgttttattttttaataccaccctcaggcatgtaattaatattattatcctcagaataatgtttaaaactgatcttttataactgttatttcagctctcatgcattctttttgctggagaataattgattcatctcattatttgccaggtttagaccttagtaacttgtacatccctatgataaaaattattttggaatggaaagagagatatctaaaaagggatgaaatcatgccaaacatcttatctctaacataaaaaaaattaaatttgaagccagaatttcagttccagttctacttttagcttgtgtgaccttgagaaagtcacttaagcatttctgagcttcaagtttctcatttgtaaagtcgaagtaagaaataccttttatgcctagcactcagagttcttgttggatcaaacaagatttgtacatttagttggaaaactcaacatttgtatctaaacataatgtattccagcagagaattactgtccaccattttcatttatacattttaaatagtgatttattgatgatcttcaatatgcaaggagcactgctagacactagggaaataaaagggaattaagatagtacccaaacacttcaaatcctcatgggcaaggacacgtgaacacataataaaatactttaatttcaattacagacactaatgggcaggttgttaatagaatgtttgccaactttaagtagttttataataaaatataatagtttaaaagaaaggtctattaataaaaacagaattaaaatatatatagatcaaataaagtatggaaatttagttgaaaaattggcattaatcagtaggaaaaagatgggcttctcagcaagtggtattgggatagatgaacagctatatgggaaaagagaaaactgaatctgttccaaatgtaacagaatcaaattctaaaaagatcaaaaatttaaattcaaaaactattatgttactaggagaaaacaaaggtgaattactctgtaacctcagagtggccaaaagtttcttaactgattctaaatccagaagcaataaaggaaaaggctaataaaggtgacaatatgaaaatttagaaaaaaaaactttttatactaaaataattgcaaatatttttcacttgttaatgcacaataacaaatggaaaatatttgcaatttttgtcataaacaaagggttgttatccctaaaatataaagcacttttaaaattaaaagaagaccagcaactctataaaaatgggcaagagacatccaaagatagtttgcataacataaatgcaaagggtccttaaatataggaaaagatgttccaattcactcataaaaatgctaattgaaatcactgaaattactattgtttatcagtaaggttggcaaaaacacaaaaggttgaaaacatacttgtggtaagcagaaaagtgacccccaaagatgtgcacatcctagttcccagaacttcacatggcaaaagagattttgaagatattaaggattatgagagatgaagattatcctggattactcagatgggcccaaagtaatcacaaaggtccttaccagtgaaagaggagtcagtcagaggagatgtatctgatgatggaagcagaggttagaacggtgtgatcagtgcctttgaaggtggaaggggactgcaagccaaggaatgtgggcaacctctacaagctggaaaaggcaatgaaatggattttctcctggagcctctgaaaggaatacaaatctgctgtcgccctgattttagctccctgagaactatttttgacttctgatttccagaactgtaagataagaaatttgtgtttttaatctactaaatttgtggtaacttgttgctatagcactaggcaacaaataaaatactcttaagaggaaggttgtgagaaaacaggcactttcatttattgttgggaatgcaaactgtacagcctctgtggaggagaattttgctatatttacatatacactcacccttagatcccacaaacacatctctgtcactgtcaaatattgtaaaaagatttttcagccctatttgtaatagcaaaaaatactgggaacaacccaaatatatattaatagaaattggttgaaagaagtgtggtattacgttgtactatgcagttgtaaaaaaattaaagttttcatcttatgctgtggaatgatctcaggcaatattgctaagtgaaagtggcaagttgaaaacaaatgtatgttactatttgacgaagaagagggagaatataagtatacctttacctacacatatatatttgcttttttaacaataaaatgataaactaaaaagtattatttgggttttcttttcttttttagtggttattcataggactgaaaagaccaggatgaaggaaatagggatggtaggtagacctaagtgtactttacttcgtagatctgaccctctagccctataaatgtattacaactatgaagttttactgatttaggaattcaaaatatttcaaatatgcacaagttagaattaatatgtgaatgaatataaatatgaatgactgaatcttatgagaatttcctaatttacagaaagcagttttcaaaactgatagaggatggagttcattaaaaatatttattcagaattcattatgacctcatcatcaagtaggggaatcagatgatatataattatactgcaaggaagatgatgaaacatccaaaagagagatttaaagggatttcagagaaatgagagtgcacttccacctaggagaataagaaagattttgcgctcattcagttagttatatattcaacaaatatgtactgagcccctattatgagcaaactctgttataggcagtagggttcagtgatttttaaaacagtcaaaaactcctaccttcatagagcttacatgcttataagaatgagggtaacagacaataaataaaagatgaaaagaactgataattgaccattacatttagtgtagtggagatcagtgttgaccatggcaagagcatgcacattcctatcaccaggacattcatagtccccctagatgaagacagacatttacataagcaagtactatgttgtatgatatgttgtacctattttaaagaagcctctatagcgcttgtagtacgttgagcactttaatagacagtgagtactccataaatagacaagaaaatgatagttatgcaaactaatgttagcaattattttgtacttatactgtccagcctctgatatatttatgcctagtattttaagtaagtagcgttcttttcattttctttgctttaccaatgaaattccatagaaacaaagtattgccaacacttttggaaatgaagctgtgctgttttgcatgaggactgttctgcgtgagtttggtcaagggctaaggtcaaatttgggagactcccttctaccatgtaatagtggcatgacactaggtgaattagtttacctacagctcaatttctgcatctagaagataggaataataatacctgtgttcagtgatgttgtgaacatgaaatgggatgcacatatggaagatttgatgttattaatcacatatttttgataataaaaattctctttaactagaagtcccttttttattatactttcagttctggggtacatgtgcagaaggtgcaggtttgttacataggtatacatgtgccatagtggtttgctgcacccatcaacctgtcatctacattaggtatttctcctaatgctatccctcccctagtgcctcattccccaacaggccccagtgtgtgatgttcccctccctgtgttcatgtgttctaattgttcaactaccacttatgagtcagaacatgcggtgtttggttttccgttctcgtgttagtttgctgagaatgatggtttccggcttcatccatgtccctgcaaaggatgtgaactcatcctttttaatggctgcatagtattccatggtgtatatgtgccacattttctttatccagtctatcactgatgagcatttgggttggttccaggtctttgctattgtgaacagtgccgcaataaacataagtgtgcatgtgtctttatagtcgaatgacttataatcctttgggtacatacccagtaatgggattgctgggtcaaatggtatttctggttctagatccttgaggaatcaccacactgtcttccacaatggttgaactaatttacactcccaccaacagtgtaaaagctttcctatttcttcacatcttctctagcatctgttgtttcctgactttttaatgatcgccattctaactgatgtgagatggtatctcattgtggttttgatttgcatttctctaatgacctgtgatgatgagcattttttcatatgtttgttggctgcataaatgtcttcttttgagaagtgtctgttgatatccttcacccactttttaatggggttgttttcttcttgtaaatttgtttaagttctttgtagattctggatattagccctttgtcagatggatagattgcagaaattttctcccattctgtaggttgcctgctcactctgatgatagtttcttttgctctgcagaagctctttagtataattagatcccatttgtcaattttggcttttgttgccattgcttttggtgttttagtcatgaagtctttgcccatgcctacatcctgaatggtattgcctaggttttcttctatggtttttgtggttttaggtctaacatttaagtctttaatccatcttgagttaatttctctataaggtgtaaggaagggatccagtttcagctttctgcatatggccagccagttttcctaacaccatttattaaatagggaatcctttccccacttcttgtttttgtcagatttgtcagtgatccaatggttgtagatgtgtggtgttatttctgaggcctccagttctgttacattggtttatatatctgttttggtaccagtaccatgctgttttgctttgccttttagtgtagtttgaagtcaggtagcatgatgcctccagctttgttctttttgactaggattgtcttggcagtgagggcacttttttggttccatatgaactttaaagtagtgttttccaattctgtgaagaaagtcattggtagcttgatggggatggcattgaatctataaattgccttgggcagtatggccattttcacgatattgattcttcctatccatgagcgtggaatgtttttccatttgtttgtttcctctcttatttccttgagcagtggtttgtcattctccttgaagagatccttcacatttcttgaaagttgttttcctaggtattttattctctttgtaggaattgtgaatgggagttgactcatgatttggctctctgtttgtctgttattggtgtataggaatgcttctaatttttgcacattgattttgtatcctgagactttgctgaaattgcttatcagcttaaggagattttgggctgagatgatggggtttcctaaatatacaatcatgttatctgcaaacagggaaaatttgacttcctcttttcctaattgaataccctttgtttctttctcttgtctgattgccctggccagaacttccaatactatgttgaagaggagtggtgagagagggcatccttttcttgtgctggttttcaaaggtaatgcctccagtttttgcccattcagtatgatattggctgtgggtttgtcataaacagctcttatgattttgagatacgttccatcaataactagtttattgagagtttttagcatgaaaggctgttgaattttgttgaaggccttttctgcatctattgagataatcatgtggtttttgtcattggttctgtttatgtgatgtttacctttattgattagcgtatgttgaactagccttgcatcccagggatgaagccaacttgatcatggtggataagctttttgatacgctgctggaatcagtttgccagtattttactgaggatttttgcatcgatgttcattatggatattggcctgaaattttcttttttggttgcatttctgccaggttttggtaaccggatgatgctggcctcataaaatgagttagggaggattccctttttttctattttttggaatagtttcaaaaggaatggtaccagctcctctttgtacctctggtagaatttggctgtgaatttgtctggtcctggacgttttttggttggtaggctattaattactgcctcagttttagaacttgttattggtctattcagggattcgacttcttcctggttttgtcttgggagggtgtgtgtccaggaattttccatttcttctagattttctagtttatttgcatagaggtgtttatagtattctctgctggtcgtttgtatttctgtgggattggtggtgacatcctctttatcattttttattgtgtctatttgatccttctctcttttcttctttattactctggctagaggtctatctatttcgttgatcttttcaaaaaaccagctcctcgattcattgatttttttgaagggtttttcctgtctctatctccttcagttctgctctgatcttatttcttgtcttctgctagcttttgaatttgtttgctcttgcttctctagttcttttaattgtgatattagggagtcaatgttagatctttcctgctttctcttgtgggtatttagtgctataaatttccctctccacactgctttagctgtgtcccagagattctggtacgttgtgtctttgttctcattggtttaaaagaacatctttatttctgccttaatttcattacttatccactagtcattcaggagcaggttgttcagtttccatgtagttgtgcagttttgagtgagtttcttaatcctgagttctgatttgattgcactatggtctcagaaactgtttgtcatgatccgttcttttgcatctgccgaggagtgttttccttccaattatgtggtcaattttagaataagttcgatgtggtgctcagaaaaatgtatattctgttgatttgagatggagagttctgtagatgtctgttaggtctgcttggtccagagctgagttcaagtcctggatatccttgttaattatctgtctcgttgatctgtctaatgttgacagtggggtgttaaagtctcccactattattgtgtgggagtctaagtctctttgtaggtctctaaaaacttgctttatgaaactgggtgctcctgtattcggtgcatatatatttaggatagttagctcttcttgttgcattgatccctttaccattatgtaatactcttgtctcttttcatctttgttggtttaacatctgttttattagagactagtattgcaacccctgcttttttttgttttgcatttgcttagtatatcttcctccatccattcattttgagcctatgtgtgtccctacacatgatatgagtctcctgaatatagcacactaatgggtcttgactgtttatccaatttgccagtctgtgtcttttaattagggcatttagcctgtttacatttaagtttaatattgttatgtgtgaatttgatcctgtcattatgatgctagctggttattttcccctttagctgatgcagtttcttcctagtgtcgatgttctttacaatttggtatgtttttgcagtggctggtaccagttgtttctttccatgtgtagtacttccttcaggagctcttgtaaggtaggcctggtggtgacaaaatctctcagcatttgcttctctgtaaaagattttatttctctttcacttatgaagcttagtttcgctggatatgaaattctgggctgaaaattcttttctttaagaatgttgaatattgtcccctactctcttctggcttgtagggtttctgtcaagaaatccactgttagtctgatgggcttccctttgtgggtaacccaacctttctctttggctgcccttaacattttttccttcacttcaaccttggtgaatctgacaattatgtgtctttgggttgctcttctcaaggaatatctttgtggtgttctctgtatttccagaatttgaatgttggcctgccttgctaggttggggaaggtctcttggataatatcctgaagagtgttttccaactcggttccattctccccatcactgtcaggtacaacagtcaaatgtagatttggtccttttcacatagtcccatatttcttggaggctttgttcatttcttttcactcttttttctctaatcttgtcttcttgctttatttcattgggttgatcttcagtctctgatatcctttcttctgcttgtgattcggttattgatacttgtgtatgcttcacgaagttctcgtgctgtgattttcagctccatcaggtcatttatgttcttctctaagctggttattctagttaacaattcatataacctttttttccaggttcttagcttccttgcattgggttagaacatgcttctttagctcgaaggagtttgttattacccaccttctgaagcctacttctgataattcatcaaactcattctctgtcccattttgttcctttgctggcgagaagttgtgatcctttggaggaggagaggccttttggtttttggaattttcagcctttttgcactggtttctccccatcttcatggatttttctacctttggtctttgatgttggtgatgttgatactattcctttctgtttgatagttttttccttctaacagtcaggcccctctgctacaggtctgctggagtttgctggaggtccactccagactctctttgcctgggtatcaccagtggaggctgcagaacaacaaagattgctgcctgttcctacctctgaaagctttgtcccagaggggcacccaccagatgccagccagagctctcctgtatgaggtgtctgtcggctcctactgggaggtgtctcccaatctgtatacacgggggtgtcagggacccacttgaggaggcagtctgtcccttatcagagctcaaacactgtgctgggagaaccgctgctctcttcagagccgtcaggcagggacatttaaatcactgaagctgtgcccacagccgccccttcccccaggtgctttgtcccagggagctgcagtgggctccgcccagttcgaacttcctggtggttttgtttgcactatgagggtaaaacccgcctactcaagcctcagcaatagcagaatacttttaattcttatgggtgtacataaatgttaaaatacattagcttatttttgtactttatagagtagatgcaacagaatcaattttgtttttataaaaaaacttttggttatgtaatagtgtcaataacaaaatatttgtattacaattttaaaatacttcattcaatctttgcaacagcccattaatataggcatttatactaccttaatcttatagagcaataaaaggagctcagaaatacaaaaattaatgcctataatattgtattattttgtttacgcggatgcaggaagtctgggttaggctgaatatattttgtcttgaggaaattggcatttttaaataaatttttgttttgatttacctttctctttaaatcagggtttctcaactagtgacactagtgacagtttgcactagtgaatacatatttgggttgttctatgagaaaacataagcactagtgacatttcgcactggtgatccattgttgtggagggccgatctgtgaatggtaggatgtttagcaccctctctagccactacccactagatgccaggaacacacttgctccatttgtgataaccaaaaatgtctcctacccatattgtcagatgacccctgggggagtgaccaggggacattagtgagaacgaatgagtgaggaaaaagtgagaattagtgagatgtgttaaactacagtagagcaaagttttaattaggttttgactaatgttttcatttgtattaaaaagtaaagatgataattttaaagcattttatgatatagtcactaaatatttgagtaaataaaactttttttttttttttaagatggaatctctccctgtcgccccggctggagtgcagtggcatgatcttggctcactgcaacctctgcctcctgggttcaagtgattctcctgcctcagcctcctgagtagctgggattacaggtgtgcaccaccacacctggctatttttttttttttttttttttttttgtatttttagtagagaccaggtttcaccatgttggcagactgatctcgaactcttgacctcatgatctgcccacttcagcctcccaaagtgctgcgattacaagcgtgagccactgtacccggcctgagtaaataaaactttctaattgtgaacactttacattgatctgataaaatttacagaaataaaaatgtgaattttagtcaaaacaaagaactatatataatatatatttttccatgtggctcattacatatgattttaattaatactttctacaaaacactgttcattactcccctttccaaaaaaaaagactaaactcttactaaatatatttgtggttttggttttaatggttttgtttttggttttacaaatactgattaaatgttagtagggaagaagtttagttttattttttgctctagtacatgtaatattctataaattttattgtgatgacatgacattttcctccttcaaaaagacagcagatgaatgaaaaatatatttttacgtattcattggtactgaattttaaataaaaataatttataactaattttaaacattcctaaatggtaagtctagaagacttttaaaaattgaataaaacaatttacagtttaattatatgacttagtagagcacattatttcctattatcctattaccctgattgaaagataaatataaatgttgggttattgttggtataattaagccattgaattgtaaacatctttcttctgaaacaatacacacacacgtatataaaaaacaatattattcttattagctatgaataaaaaatacattcctatgtatatactggatttcagatgacagaaacagatagaagatagtgtccaatatttttgttctacttgtttgaaaggttatcaagtagtaagtaataccagcagagcatgaaaatgaccagtaatttaaaagtaatcagacaaggtatagtttgttgtatttttaactacagaaggctggtcaatagctgcactcaatttgctgttatttccccatggaaagcccagtttgttagctttaggataggcgcagtcaatagattcttttttactaagagaaatgatccatgggaggtctcctaaggagtaaagtcatgagaaaacataggcagcctttcatgctgcacaacacaactagggaagtaagactctgacctatttgaggtagcgtttcaaagactgcactgttggagctcttttttaaaaaaatcaaatcatgtaatcaaaagaaagctgaaaataatagcaaaaggctagttttattagaaaacttttgttctattataataatgcattatgtgaagtgcttggaattggcctcaaatactgttaaaacacatattaaagaagccaataattacactttgtaagtttgcctctttgtgggcaccctttgtcatctccttgtggaataatttgagaggtggaggagacacatagacattgggcgaggtaaggaaaaagttacaacacacattccagtgctctaagacctcattggaccacctgctgatccagatatgtgtatggtggagacacaaaaatcataaataacttcccccccagttaaatatcgctgcaattaaattctccatttgagaaaacaggattgaagagtgatgcccttgttgacagcatttattactgtgggctcacctacttccaaaaaagaattgagatgacttacaatgaaaaggaaggacaaaataacagcacatttgctgttgctggtggtgttggtgttgggttttgttttgttttgtgagtggtgtgttagaataaactttggagtcacagcagctggataaaaatcctagctttttctcttataagattttgacttgggtaggttaattcagttctttgaactttgtttccttaaataaaatcaggcacaataatgactaattcaggattgtggtgagaattaaatgagctaaaataggtaaaacacctaggatactacccaaaacaaagtcggggctcaacaataaccattactttcctcccttaagaagatggagattttaaggaagcttacccacaagggctcttttctctttctctgtcaacttattgtcttttaagtatctaagatcacaataaacatctccaaattatgtaaaaaagaaattggccattgtcagaattcattattcaccaaagcttctctgagcacttgctccatgtatgacacctcacacatgaactctggggaatatgagaagtagctggcatgccccagccccagcagaaggctctttgctgcttggaaaaaggaattcaaaacactaagtttccttctttcttctgtttcaaaaactattaatagatatgtcagtaagcctgaaagttttattcctcctggctcagactgcactgatgacttcttcagaaagcctgcctggtcttttggcagatttgctaggatttggatgacctcatccatgatggctaaaagtatatagaagggtcagattaatttaatgcagaaaatctagtacatcctagaaaataatgaaaagttcaaaattaagaattcattgatggaaccagtcatttaatgtgagaagaaacaacacagtaatatagaactcagtatttaaaaaataatcagtacttatgaattattttcttaaggattaacttagagaactgaaatctgccatgtaatttatctagattgtaacatgatttggggagaaagggtacatttacatcccacctaaaactaacctcccataaatagtatataacattatataaattataagaatacaaattactccatacttgagaaagttactatcaataatttatattgacagattctaatgacataaaagttttaaatgtaaccagttaatcatcaacataattattctttaataactttacttttgaatttcttcagtggcttagaaaatgaaagcatacaatttttctaactgttgaaatatctttattcatttttgtttaaatttttgaaatgttctttcttaagttaaataaaaattatttagaaacactaataggtaaaatataaaggtatattaaaatgtgatcagcactttttatggcatttgtataatatttgataaaatttcagatggattgggaaggtttaaataatttatctaagttgtaaaagttatcatgcaataaatatactcagattcttatcagtgagtttttttgttttgcgtatatattttactctatgcagtttgtatcaaaggttaagattcatccatgaattaatgtatttatttattcattcatttattcatcattcaaaaatatttattgaacaactcttttagaccaagatctatgttaaatctggaattggaaacatgaatataacacaggccttgctcctgagactcacataatctactaagggagagacacagatacttgaccatgtgacagtacatacatagagaaatgtacgtattctctgtgaacaaaaagaaaatagaaactaattatgctcaggagaagtggggtaattatttcaatgagagggcagtatttgagcaggatcttgaaaaagaaaaaagataaatttccctagtgaacagagggcattccattcaagagggaacatgatctggttggcctagttgtgacatggagcctaaggaaaatgatgagaggcaaggaaggggagtcggggatgggcacaaagattctgaattctgtagacagtgggggactggagaagacttctaagcacaatcaataagaaaatgtgtgtgtgtctgttatatgtatttagaaagatatctgtgtgtgtttgtatacacacatatccattaatgtatatatacagacatatacatatgtatgtatgtatttatatgtatttttgtatttaaaaatgtatgtatgtttaaaacttctatagcatggaaacacttttagaagaaatattgaattgttttagtagatactaaatgcctattacataacattcacgttaaaagtttgaaagaaacagaagatgatacggtgaaaatgaaaactaagccattcttctatctcaattttctagccacctacttgccttcctagaggcaatcactgttttcgggatttttgtgtttctttgaggtattgtatacaggtactagtatttgtgttctctgctttatagatgcagtgttcttaccttgctagataattccatatcagcaattaaggaacaactacgtttttaaaaaattaaagactttatttttttagagcagttttaggttcacagcaaaatttagaggtaggtactgagatttcctatatacctcctgcctctgcatgcacagccttcatcattatcagcatccccaccagagtgacacagttgttacacttgatgaagctacattgacacatcataatcatccaaagtccattgtttacactagagttcactctttgagttttaccttctgtgggtttgggcaaatgtgtaatgacatgtatttatcattatagtatcatacagagtatgttcaatgccctaaaaattctctgtactctgcctatgcgtccccacacccactcctgctcccaccaacccctggcaaacactgatctttttactgtctccataattttgccttttccagaatgtaatatagtttgaatcatacatttctatgattattgtgataatatgtagacttttcagactgtgaaatgtatattcacacagaaatatacatttaagtttcctccgtgtcttttttgtttgtttgtttttttgttgttgttgagatggagtctcactctgttgcccaggctggagtgcaatggtgcaatcttggctcactgcaacctccgcctcccacattcaagcaattctccctgctgcagcctcccaagtagctggattacaagtgcctgccaccacacccagctaagtttttttatttttagtagagacggggtttcgccatgttggccaggctggtctcaaactcctgacctcaggcaatccgcccgccttggcctcccaaatcgctgggattataggcatgagccaccatgcccagcctcctccatgtctttttatgtcctgatagctaatttcttttttagagctaaataatatcccattgtctggatatatcacagtttatttattcattcacctactgaagggagtcttggttgcttccaagttttgacaattatgaattatgctgctacaaacatccatgtgcagatttttgtatggatataagttttcagctcctttgggtaggtatcagggagcacaattgctggatcatatggtcagggtagcttagttttgtactgccaaactgccttccaaaatgactttaccattttgcattcccgtgagcaaagaatgagaattcctgttgttttatgtatttgccaggatttggtgttgtcagtgttttcgattttggtcagtttaagagatgtgaaatagtatctcattgctgttttactttgcatttctctgatctacagaacatcatctcatatgcttctttgccatgtgtgtatcatctttggtaaggtgtcagttaacagtctttcatccattgttattgttgagttttaagagttcttcatatgttttggataacatgcctttatcagacgtcttttgcacatattttctcccagtctgtaacttgtcttcttactctcttacattgtctttcacagagcataagtcttcaattttaatgaagtctagtttatcaataatttctttcatgaattaagcctttggtgttatatgtaaaaaattattacagtaccgcaggtcatctaggttttctcctatgttatcttctacaggttgtatcattttgcattttacatttaggtctacaattcattttgagttaatttttgtggagggtactacctcacttgtaatggctgtatagtgttccacagtactatattcaactagtcccccactgatgtatacaattagactttttccaatctttagctattgcaaacaatgcgacagtgaatattcttgtccagctctccttattaaccatcctttcccccccccggctcactaaagatcttatcatcatctaacatactatgtattttctttattgctttcattatcaaacttcactcctgtcacatattagcatgttagatccaaaaagcagagattttttttaatttgtttcctactgtaaccctagtcatagaataaatgtttaatgaatatttgttgattgaatgcctcttacacaagtatatctacaggaaaaaatcatagaagtcaaattgctggttcaaaagggataggcatttgtaattttgacagatattgccaaattgatcattatagaacagagcatttcaaccttgacactactgacattttggcctgataattctttactgtgtgaaggtatgtgctgtaggctgtttaacagatcctccagttgtgacaaccaaagatgtttccagacattactaaatgtcccttgttaagaagcactgattgttatgcaacctttgactctcactgacaattatgaaaatatctccccacagccttgccaatatcgtcttttaggaaacagttcactctgaatatctaatggtgaaaagtagtatctcatagttttaactggcatatgaattcacattttgatggaactttgctgtaacaaatccccagcactgtacattgtaatgatgaaggtaagtttggttttccactgtagagggaaggcgggggatagagtgaagatatgaaatccacaatcaagtgtagaaaaagtgctttttgctcttatttttcttcgttaaaatatctgttttataaatcctttcttatcttcagactattatgcattcatgggctgaatcttctctagaattatatcaactggccttgattaatgaacaaaatttggagtcaaaagccttggaatttgagtgcaggctctcctaattactagttgtgttaccttggggaagtcacataaactctgagctgcaatttactcatctgaaaattgtggataataacatttgctctctctacatcactgagttattgtaagaattattttttagactgcaaagcctttcacaattgcaagggtttatgataattattatgaaggttttatgacccgctgctttatctcatgactcacagtgtcccgagagtttttctcttctcagtgcttctgcgatcacctcaaactgttctcactcatttatttattaaacatgggcattgtgtagccttaccatatcttcaactctgtagcctaaataatttcagaacaattctcctcctaactgaacaagtcccagatagactcatcatttattcagcattcattaaataagtaccattgtcttccccaaaactgccttttcctcccaacagccccatttttgtcaatgccatcattttttctagtcttgagggtgggaactttgcagtcatctcttgtgcttgtgctccctgtcccatggatcctgcataccacaaccagattaaagtagactacctccttcttcaggtcccttcttgtgattataagctgagagtcccctgttgagtgccacatcaaatccaaattatatttcagtagcactccttgttacccatattctcctaaactactttttctttccttgcaccagactcattcttgcacctatgcttttgttcatcatgtttttctccctagaattttcttcacctgttcctttacctatcaaccagcaccaactttcaagacgtctatcatccctattactctatgttctctttttctttatagctcagcttactctaatctcttttatcacttcactctcattgttattggtcagtttaacttaatgtatcatagtggatctcaatcctgactgcatatcagaatcacctcagtaaagttttgtttgttgtcttaatataatcccaggatcatgattggggattctaattctagacagagctttgttattataattttagtagagtggtttgaacatcttcatggatattttaagcaggtcatttttctcttccagaccacagatttataaatttactggtagtaagaatgttaaagacatcaatatacccaatgctcaataattgattaactgatagtgtgatataaaaatatttcttattcatttcctgcacagcctataatttgtgtgctacctcttccagtttgtggctctgtgactttgtataaattgctgaatctcttaacctcatgtttctttgtatgtaaaatgagaatagtaacatatatgttgctaattatgagaagtagagctaatgtacataaattttcagagctacatggtggcttttttattactattaatactatatagtctctctgctgttgtagagatgcttaaaaaaccctttttctttcttgctttatgatttgctattttatgacttagtagatttacttatttacattactattggaattaagacaggatatcaaggccctatcaaatcaccatgtaatttgatacctaattacctttgatacctttgaaacctaattacattttcatattttaaggagcaaatgagtattctattttttgaccatcgttctactgactgttttcttggttacaagagaatatgcaccattacagtttttccttgtcagcagcaactccacgccgtgaacacgctaactttatgtatcttcttcactttacctgacattgccaagtaggtgtttcttcctcctaactgtaatttaaaagaggatatttatttttaacttagctcattttattttatttcatagtttataactatcccatttaattttaaaattaaaggaatataatactattctattaaatttagacttacagattgtgctcctgggatcagcaagaaaacataaagtactttgtttccacaaaagacacttcctatataaattatttttattattaagttctgtatctttaaatgagtcacttttaaatctttttcttgtcttactagtgaaaaaatttaaattgtattattaaaggaaaacatatagacatatgaatgagaaagtattcattaataacttgtcttcattaagttagatgaaaacaataaaaaaggaattaaccaaagtggcacattgccaatcataagacaggagaaagtttccagagcaattaaaggaaagaaattatttgttcaaccatggacatttatactgttttttcagtttcaaagttgtaaaagtaatgtatggaggctatcttctcctgcaccaaaacaagaaaccgtataggtttctttggaatgcctattaatcatgcattgctcccataaattagtcaaagctaaagaaaaagtgttgctaaatagtgcacattttcatttccctgaatatttgtagctgcaatttatacagataccaacaacactgtgggctcagaattaaaatgaaagtgcttgaaaacttgtgtgaattacctttcttacagtatatttatggagccaaacagacatatgtttgattctcatttcatccgtaacatgaatatattgatacttactttataaaattattgaaaggattacatgcatttaccatggtgcctggcacatagcgctcagtacattgtagtaacgggctatgctgttttgagaagattgtgtggagagaggatatcactgactttggagttattcatgcctggttttatattccagatctatcatctgataactggctgatttcggccaaattactactctgaatttagtttccttgacaataagctaaagtgaaataacagcaacctcatagggtggttctgaggatttaataagatcatacatataaagggcttccaatgcctgttacatatcatatctttcagtaagtagtagatcttattactcttattcttactgctaaaatctgtgtcttaggttcttgacttctttgtaaatatgcctttgaacaatgtggaagggtcaaacaactattaccccaggagtatattgactttgaagctaatgcagcttaagcctaagggcctctcatttgcacaagtcccttccaaactgacacttaatactcttcttaattttatattctctttcttaaagaagacctccgaagctccaaaaatttcaggtttcagaaaacctgggtctaggttatactattacctgaagggttttttttttaaaactaaaaaaaacaagagaaagtttataaggaagcacaataatgtatgctatctaatgaatatattgatagcaatatttatattaaattgctattttaagcctaaatcctataagttctattttgtgcattcagcttcaaaatgattctactggtaataaaaatggcatactaagcaatgaaaataagagataacttgagtacagcaataaaactcaaaggaaatgtaatcagtgatacagaattatgtaattttgtatactcaatattttctaagctacttttcagaagaaaaagaatagttttaaccaatcagtgagaaaggtaactgattaagcttattcaaaataaatatctgtcttcctcaaggcaggctgtgtcaaaagcatattgaggcatagatcttccaacaaattataaattaaatgtccattactcacacatgcaaaaattgaagttgagaaaattacataactgaagtcaataaaacaaactctggtattatataaatacactgtaatccacagaagatatattcatgtttaaaatggttagcttcaaatttttgagaaaaaaatacttcaaggtctttctggtaacatcagttggtaagttagaataaaaccttaataaaaccagtaaaaagactttgtaatttgcattgctcatctcattctttaaaagaatttattgatagattttctcattatacctacatgttcagtataaaatatgaaaaatatccaaaacgtttttaagtcaggtgcttttaaaatatgtggcttccccttgaaaagtatatatctactcaaaatatataaagtatattaaaatttgttcatcttaaaacaaaattgcaattttatgagacaatattaacttttgaggacgtcaaatgtagaaattgaagctcacagttaataacagaaaggatttgctaccatttatcaaataccttaccctggtattatgataagaaacatcattcccattttacagacaaagaaatatcagagcaaccagggttaaatgactttaccaaagttattattacaaccaggactagaattcataggattcttacttttttttttttttttttgagacagagtctcactctttcgcccaggccggactgcagtggcactatctcggctcactgcaagctccgcctcctgggttcacgccattcttctgcctcagcctcccaagtagctgggactacaggcgcccgccaccacacctggctaattttttgtatttttagtagaaacggggtttcaccgtgttagccaggatggtctcaatctcctgacctcgtgatccgcccgcctaggcctcccaaagtgctgggattacaggcgtgagccaccgcgcccggccagaattcttacttcttatctgcctcttaatcttgttaggtcaaaatctctcagcatttttagaaaatgccttttttattatattttcagcagatcatgagtctaatataccagcgttacccttttctatgctttccttccttgagaacgctttcaggagagaaatcagttatagttttctgtctcttccaaatagttaaaaacataagagatcatagatgtagtaaatcagtttagaatcccaatgccttgattgggatgcttaattttactataatagcctaatctgaaatgttatctgaaaggcttatttcttcacattcttttctacaccacaaaaattgttcataacaagaacaatcttgggggaaaaataagatgagatgttttagacagcttaatggggctgccactgtcttggataaccactgtttagagctgtcttggattagctgaaggctagtgttgactgaacatattgaacaccatcttaagttgtactttaagtcaggatagacagtccttacaagaaatgaaagctgctcctttgaccattataggtgttctgtggctagagatgaagtgccacactaacagaacaaagcttgcaatttgtggaattgaattccaaggtgaaaaagaaggttaacaatttgtgtaaaatcctctctcaagaacagaaattccaaaagtattgattacaatattcacaatggcatttcacactgtggctggtgcttttaaataggagtcagagaaaatatcatgttgcttaatatttaggcaactaattacaaaattctcgattaccaagtctcactgaagtgttcccttacgaaaacgtgaactttattaggtatcaactcattgacatggtccatttgaagaagcaatttattagtctaatggttaacacctgttagatgaagctcaaaaatgaaaaagattttaatgaaaagcaaatgcagtaaatgctagcttttaactggtttcataaaagattgaatatatattcaatattctgtatatatatatatactgtataaatatacaaaatatatactctgtctgtgtgtgtgtgtgtgtgtgtgtgtgtgtgtgtgtattacacaaactctccttttccctggacaatttaagtacattttccctgtaagctaaaagccataagtatccctacagatattttttgcaagtgaaattgcttttcatttggcaaaaactaaacctgtgattcatagcagcttagagcactcaaggccaaagagtacatcttgcttgctttgactgacatttttgcaggctaaatcagacctgcatgattcagctgtactgagattcataatgctgtgagcagagaaatttgggggtggtataaaagagcatggagggaaattgtcttggaaattgtgactactgactgaggcaaaaatcaaccacagccaataggcggtttcaattgatatttgattggggaggcgttttcttgctaccctctttatacaaagaacattagagaaattttagtgaagaaaactactacggaagcagaaaaagagggactttactatgagaaatgaaactgcaatagggagcaagagcagggagaatgactctttttaacagttgtcagctcaaatattaaagggaagtgcacattgtatataaaaggaaaagtggcaaaaaatccattcccaaaaaatttctcctaaatgtctaccattagcaattcattcctttcagatttcttcattgagttcattcctcagttgcccttaaaattcatatgcccagaggagtaaaaatcttcctacatgaagttatttcctatctggactacaaagggagcacaagaaaattgctttgggaagttcaggcctcaggaaaatacggtgtttaaaaaagattactatatagcttatgctaaccaacacctcatttttgcttaatatttattttattctgtctcactagtaatatataagatatagcccagtcataatggatcttattcaggtatggctacgtaatctatggtacaaaatgtaagtatgagccacttattaaacaaattattaagaatttcagcagagcattcagccaagcttagagcccttctaagactggggacccctgcacctgcacagatcacatgctcatgaaatcagccctcattttatttgatggtagtgaactgtgtgaattccaaacttagttaatgaaagtgtttcgttacagattacctaaatattttggcttgtaaatgctcaacacaaatattaataccaaaaattcaaacccaaattctttttgggttaattggaggctttgcaaatcactaaatttaactatttgttcctatctccctccctttttgtgtgatcttctatgggaaagtataggatttatgaggttacacattatcatttcagatttggacctctcccttaaacctgaggttcaagagcctaatcttcactctctattcctaacttatgaatcatctagctgaaaatagccaaagactgctctctaatagccaccccaaaccagcactcatcctagaataaccaataatttccccagccccaggtgtggagttaggatgagtgtggataatacctggttgtgccaaacactaaaagtagattcactttgggaggccgaggcgggcagatcacctgaggtcaggagtttgagaccagcctggccaatgtggcgaaaccccgtctctactaaaagtacaaaaattagccaggcatgatggcaggcacctgtaatcccagctactcaagaggctgaggcagaagaagcttaacccaggccacggaagttgcggtgagccgagatcacaccactgcactccagcctgggcgacaagagcaagactccatctcaaaaaaaaaaaaaaaaaaaaaaaaaaaaattagattagtgaaagctaggggtggctttgggcaaggtgctctgagggcccagataatagggaaattaagcctataagagtcttgatcacctaagctataaaaaacacttctgggtagaagaagtttttacattccaattcaaacttgagtatgctgctgtttaagccaatatttatttcctcttagcatatgtttcaactttagtaccgtccaacaataagatacgtattctctattaaaatctccctcttcatcttttgttgacacagcactataattagtatcacataattcctaccactgacagaatgccccagaatattttgtcttatttttttttcaagattagctagcacttataacacttcttgctaacgtttcactcagttatagttggagttagtgaagtcatggtttgtttttttttttatgtaaagctgtcttttcttcttctcacccccatcccacaggcatcaaaggaagttaaataaaagaatgactattgtgacgttgactaatagtcataagacattagctaagaaatgaataccattgaggttttgaatgatcagctgttaatttttaagattatactttagaaaataataaatcctgcttttgatgagatgtccattaaaaaacttattttaaaagtaatatattttgagtaactacattctgtccaatgcaactctaactgcatacttctgaaatgtttacccccgaatgatcccttctaaaacatatagctttagcttgtcagtttactggcattgaatttcaatacttaagttaaaatatattgaatcagctttgcaatacttggctggatcttttagaatagtattattctttcatcttacttatagaaaacacctaagtaaaatagtattcatttttaaacttcaatttattgtatacagagctttctttcttaatagattgacttcaagaaacattttttcttcaatcagaaaatattgacttattcttctgaattgaatctgtataagatttaaaccttccagttattacccaatataacaaaattaacatgaaaccaaagctctcgagcaaaagttataatatttgaacttaaaaagacaaatatcctatatggacttcaaaatatataataaatcttaaggagtcagtgcaataatttttttaaagcacaattttatttaaggtacaataagggtttaagaaggagaaaatgggccaagcacgatggctcatgcctgtaatcccagcactttgggaggccaaggcaggctgatcacaaggttaggagttcaagaccagcctggccaacatggtgaaaccccgactctactaaaaaaaatacaaaaattagccgggcatggtggcatgcacctgtaatcccagctactcaggaggctgaggcaggagaattgctttaacccgggaggcggaggttgcagtgagccgagatcgcaccattgcactccaacctgggcaatgagagtgaaactccattctcaaaaaaaaaaaaaaaaaaggagaaaatgaatttacagaaaagtcgaatattcttttattaaagcagctctgttatacaagaggtaacactgttataggctgtctgctttcttgatgacatagccaattagtttgtaatctaggcagttatcaaggttaatcacaaatggaagacaatacatatttaaaataaatgagatagttcaggaataagtggtatattatctagcgagtaaattcagtaccaaaatcagtctctaggatcttactccaaagtagaccttggcctccaattatataaagcgtatgttaatctggacatggagtatctgtagctaaatagtatatgccactaccaagtaccatttggcctccctagaagaatgtgacctgatgaagaataaagaatatttcataataatgtacagttgctagataatcttacctcttttggtagattaaagatggcttcaaattctttgacacttcttctgttaagaggtggggtctaggtctcttcctcttgaatctgggtgggatctgactgtctgactaacagaatgtggtggcagtgaagtttgtcagttttggggtccaggcttgaagacaatggcagattcccctcctgtctctcgtaatattcattcttgaaacgaagctagaggctcgtacatcttaatgtttgaagagacctgtgtgcaaaggaaccagtgtccctgctgacagcccttgatgagctgacagctgacagccagcaccacctttcttggcctatgaatgtgttatcttggcaaagatcttgagagatgagccacatctccaagccctacccaaattagattcagttgtattgggaattctgggattggttactgccatttgcagcagggttagcatcttaagagtgcaggagaagggccaggcgcggcggctcacacctgtaatcccagcactttgggaggctgaggcaggcagatcacttgaggccaggagttcttctcagtacagataagcataaacattaattgtaatacatactgaaggttttaaggatgaaatgtactgatgtctctaactttgaaatgtctcaaaagaaaaggtggattaataaaggaacaaactgatagatctgtgatgaggttgtgataaagcaaatgtagcaaaatattaagaattgtagaattgaggtgataggcatatggtggttaatatacaattttacttttttgcatgcttgaacatttcttttatgaaatgttgggaaaaacaaagatgtgaggtgtttgacacctagtaaacattcaaaaagtacaaggattttaaaattgttactagttttatatttactagtaactgaataaaataaagtatttatatagcttcatttccttgaaaaattcttctaaaatattaatttcagtataacttgatatactaaaatatcaagttattgatattttaccaattttgactttgttatatcaagaaatgtaaagtcttgctaagcaaatagtatatttcctgtaatagatcttgaaattcagtaataatcctgtagcactaagaaaaattaattgacccaaattccatggtatttgatgtattttaagataagttttactaaatttaaatttaactctagtttaacacaagaaagaagaaatccagcatacaattctaactgaatatactgttttcaaataaacagttcatttaacaaaaactggccctgtgctagatgctgtgggacagaaaattgagctgcttaacacaaggccctcacccacaaaaggctttcagtgtggttaggaagaaatatgcaacccttggggaaaaaaggaacaatgcgtgagttaaaaatataaaacatgtaacaaagaagtaaatgattaagaatcaagtgaataatatagataatatgagctgagagttcagaagatgaaaaaaatcattatagccttgaagtgaaaattttgggagtttcactgcctatttaagccctttggaacatgaaagaaacttattgcgaacttgtggttttggtagaagacaaaacacaattgaataaagagtaatgttcaggggccggactttctttgagaattatggagaggagggaagaataaaaacagaacttttagccgcaatcagctagaaattgtagctgaatattacaacctctcttcctttcaagagatgcttatttattgtctggttcatataaagcattaggataggtgctgagggttactatgaatgaaatttggccctaacttcaagaggtttaagagtaacaataacaagagctatctactagatgacaagagtatgccaggctagtcgaagcttatggcctattagaagaggtaaggaaaaaaaactgtaatatagaaagtataaaatgtcaaatgccatttaaaaagaccagataaaatgctaagtgaattcagtgaagagttttcttatagttgtataaaggaggataagtatttatgcaggaggtaacactgagttggtctttaaagagcaataagtagattgtgaacagagatatggtgaaagagtaaagaaagggataagaatgatccaatgaacgaactaaatcatatgcatgacatcgaatatgtgattctttccagctacagtgcagactatggagagaaggatgattgaaagggaaattgggccagaccgcctaggccttgaataccatgctgagtgtcttgggctttattctgttggcaacaggaagacattaaagaattatgacctgaggaatgaaaagttgagagctttttggtttttattgtttggtgttagtctggtagcttgtgtaggaggaattggaggaagaaaaatctagaggcaaaatgaccacaaggcaatgaggacgtgaaccaaggacactgaaggagctatttcagaggataaagggatataaccttgcaaccaattcagtatcaagagcaacaggacagcagagtataccaaagtggggttcagtaagttattgacattgtttagaattgccaatacatgataataataaaaagccgactagtttttagttatattattgttcttaaattccctagaaacagtattccttttgctgcctgcacccagggcagattgctcccaatgtcccccacctggtaggccattgcatggaagcagaagcacttaaagaagcttcagaaattcaagcttagcacctgggagtttgatggtgcttctaatagaaatggaaatcaggaagataaaagcagatttgggaatgagttcagttttatacatgttaaatgtgagttgtggttggctggccaattgataatgcccaacattctcaatgtgatagtggatgtaactcagctgagaagttaggacagtgctctaggtcagcgagtcatctgttaagaggtggcaattaaagctagcggaatgcctctaggtctgagggagttaatatttataattgagcatctacaatgtcactcacatatctggtctctaaagctagtggatcttaagccaaacaatactcaatgtgcacaatcaagggcacctaccagaaatttccatcttgaatttcattccttttggctcctgccaaaagtacagctgagataattggcacttgaaagctaaatattaggaggactgtgcatatatccttttttattttttctaaattctatcactacaacttaattatttgtgcctaaataactataaatatcagaaaatagattacactgaatagattagaacttagcttttacaggaaatactctcaatgatttagaaggtaatgttctgccttagccttcctctagggttggtacaaaacatatagaaaatgccaatgtagtctataaaactagtatgaaacatattgtcttatacacacatgatatgtcctggaaaaatggttctttgagaggggcaaagcaagatggccattgatcatccctactgcaggaacaccaaatttcacaactttctacacacaagaaaagcaccttcataagtaccagaaatcaggtgagcaatcacactttctggttttaacttcatattgctgaaagaggcactgaagagagtaggaaatactgtcttaaattgccactgccactcctccttcatcccccagtagcagccacatgcacggagagagaatctgtttgatggggagagggagagcacagtgattgtgggacattgcattgaactcagtgctgctctgccacaggatacagcaaaaccaggctgaactcagccagcacgcacagagggagcatttagaccagccctaggcagaggggaatcacctgttccagtggtcagaaattgagtattagcaagcctcaacaccacaggctaaagtgctctggggttctaaataaacttgaaacacagtctaggccgtgaggacggcaactcctaggcaagtcctagtgctgtactgggccagtagaccttggtagggggcacaggacctagtgagacactagtcggggctgctaaggaagtgcttgtgccacccctccccaaaccccaggctgaagagctcatggcaacaaaagtgactcctttctgtttgaggagaggagagggaagagtaaagaggactttgtcttgcaacctggataccagctcagcaacagtaggatagggcactggtcagagtcatgaggccccctttccaggccctagctcctggatgacatttctagttatatcctgggccagaagggaatctgctggccttgaaaggaaggatccaggccaggcaagattcatcacctgctgactaaagcgtctttgggcccttaaaaaccagcagtgatgctgtgggctttgggtagaatgctataggctttgagtgagactcagatgtactggtttcaggtgagacccagcacattcccagctgtggcggctacagtgagagacttctgcttcagcaaagtggagggagaccagaagaaggaatatatatggaagttctcatatacatctatatatgtgaactccaaatcaatttttaaaaggcacagtcaacttgatagagaaattagcaaaatacttgaggagacacttcacaagaggatctgcaaatgtccaacaagcatatataaaggtgctcgacttcatttagtcatcagagaaaaacaaattgaaaccacaatgcaatgccattacatatccacaagaaaggctaaaattaaagacaagcatcaccaaatccaagcaaagatgtgaagcacccataaatctcacacattactttcgggaatatccattgctacaaccatttggaaaaacaatttggtcctatattctaaagctaaacatatacatactgtatgaccagcaattctcctagatataagcctaacagaaatgagtacaagtgcttaccaaaaaaaacatgtacaagatgatttatggcagcgctctgtatacagtcaaaagtcaatcaagattaagataaatacattttagtatagtcacataatggaatactgaagtgaacaaatcacaactacatgcaaccatatgggtgaatcccacaaacataatgttgaacaaaagaagccagacactaaaagagtatcctacttatatcaagttcagtaacaggaaagactcatctatgatagtacaagccagcatagttgttacccttgggaatgtggaggaagtgcctggaagagggaataaggcaagtttctgagatgatgaaaatcttttatttttctcctttaatatgggtgatggttacataggcctgttcccttcataaaaattcacaaagctatatatttaatatttttatagttttctgtataagctatatttcaataacaacccatccatttaaagaaaagtaatctttctccacgggctgaaatcggccagattgggtaattatggtcagctgttatatagtagcaactcttacccacaatgttttttattctgttgcctttttgccctgaatgataattcctgtcgctccatggatatatttagataatttaggatatttgttccaaatgatgattcatgaacccaagaaaggattaaagaaagagttaatatcactatgcttttgaaaatggaaagactgcaaatgtctcagtttaagtgtctttacgctattctaactcagataaagtggtatgtaaggaggccatatgccacagagcccagatgttcttgaaccagtaaacattcttcaatctgaatcaggtaagatctttagcttttcttaactgcttcaaaccttaaccacctcaactttacagtttatttaaccaagctccttagaaactaacagcaggcacagcaaaatctgtttttaaaggaataaacagggcaaaatgaaattgaacctttacattaaattaacattattttatccctaatgttgattgttgtttctgttaaataattatgatgaaaagaaaaagtgttgatgcaatcacaacttgacattttgttgttaagcctcctcattttgttaaacctcctcacatcatctaattgattattaggtggctgatttcattcacctggctatagtaggccacctgtaaagcaactgtgcctatcctacagcatgactcttcagtgctctgaaaagagaaaagggctgagaagttgaaactgggagtctgtcatgttcttgattctattggtcattctgttggatcttttagaaaatcattttacctctctgaccttcagattttcaatctgtaacttaataatagcccttggcagtgaaatgtcttgaatggtgacttttaacatagcagcagtcataaaaatataagagtataactatataaaagggtttctaggagcttactcttggggcaaattgttttgccacataatattttttaaacggacaggacagttatgaaagattctagagagtgttgtcatgttaactgatcaaatatatttgttaggagcatttttattaatcagtacacatgacttagcctgttttaaacaatgtcttcaaatcttaaatatttcatttaaggatattaaaagtgcttagtgatctggttggtattattcagcatggattaatttttttctaaaagcagacaatgtatataatttattgtggacatctaaagtctaatggcactgcagaggtgatggtgaattgttaacccttctcaatagtttatgaacaggatgaaaaactagaggctatggattcatatttgtctatatgatgccacacacacacacacacacacacacacacatttaagtgtgtattaagggcaggtagtaaagagaccaaaaaatgcttttaatgttctaaattagactgataaaaatccgtagacatatgggcctctgtcatgatcaaataaaaagagttcagatttggagatggaagtagaggttcaagtcccttagacttactagctaaataactgtgaacatatcatttaacctccattcacctcagcaggttcattttgaaaaatagaacaataatgcttaagagcttactgtgactattaagtatgataataaatgttaaaatacgtataaattgcaaagtacctacacatttaagatattattgagataacctttgagttttcacattcaaatataatgtcatttaagctcatagaatagttactctttgattcttgtaagtgaattacaggagatcagcaggaattatttagctcagatagtaatgagaaagaattataaagtgattcggggccgggcgcggtggctcacacctgtaatcccagcactttgggaggccgagacgggcagatcatgaggtcaagagattgagaccatcctggccaacacagtgtaaccccgtctctactaaaagtacaaaaattagccaggcgtggtggcgggcgcctgttgtcccagctacttgggaggctgaggcaggagaatcacttgaacctgggaggctgaggttgcagtgagtggagattgtgccactgccctccagcctggtgacagagcgagactccatcccaaaaacaacaacaacaacaacaaaaatgattcggagtcagaactgtgttgaagacctagctttatctcttatttgttttgtgaactaaaacaagagattaaattctctgaatgtcagttttcttttctgtaaaattggaatgatatgccttatagagtgttgtaaaacttcaatgagactctgtaatcgctacacacagggcttattggctcttaggattaagatttattttgtatgccagacatagtcctagatgctgtggatacataggaaaagacgtgagtcttgccttcaaatccataaacgattgtgggggtaatcacatattaagacataatgtcaataaaacatgataattcccatgatataggtatgcccaaggttcatggagtagtagtagaatccgaaaagattttcacaggagctggtcctaaaccgagggttgacaaatgagttagatgtgtgtcagttgcaaggcagattctgtattagttttctagaactgccgtaacagattgtcataaacttggtgactttaaacaataaaaatgtattctctctcagtcctggaagccaaaatcaagatgtcaacagggttggtttcttttggaggctctgagggagaaaccatcccatgcctctctcttagctgttggtggttgctgggcatccttggtgttccctagcttatagttacatcactgcagtttctgcctcagtcctcacatgaccttcttccctgtatgttttcacatggccttcttataaagatagcagtcattgggttagacccaccctaatccaatacgacctcattttaactaattatatttgtaaaggacctctttccaagtaaggtcacattttgggtggacatgaattttggagggacactattcaacccagtacagggactctctggttcccccaaattaagttctatttcatgtgcaaaatacatttgccccatttcaacatcctccgaagtctcttaacccattccagcattaaatctaaatccaaattctcatctaaaaattcaaaaagtcccaaatctcatcatctaaaccaggtataggtaagactgtgagtatgatctatcctggggcaaaacccctctccatcggtggatatgtgaaactagtaaacaaattatctgctttcaaaatacaatgatgacagaggcataggtttagacattctcattccaaaagggagcaaatgaaaggaataaagggatcactggttccaagcaaatctgaaatcaagcagagaaagttccattaggtttcaaggcttgggaataatcctctcatgatattctatcttgtgggcctttgttggggcatccccaccctctatggcctcttcatccgtggctccacccttagagtcattcctcctccattttctctcatctgtgtccctttcagtccaagcctagcagtgcttgttggtataaaattctcaaaaactgtgttgattgctcatgcaattcatgggagtctgtgccattatgcaagaaggccctccacagatcttttctagataatctcttgtctattgctggcttctgctgagattggttattagatctgttaaccacacacctaatctattcaatgaaatgtccagctacaacctttgtgttctctccagagcatgttttctcatcttttgctatccaaatagactgagaatttcccaaatcataaagtgctggtttgtttttgcttaacagtttttgcctcaatttatctcttccctctcgcattttaccataagcagtaagaagaaagcaggccacacttctcatactttgctttgaaatctccttagctaagtatccagattcatcctttacatgtttcaccttccacacaacacaattgagttgaacacaactcatttctttataacaagcactgacttgcctccagtttccgataatatgttcttcattttcatatgagacctcatcagaggcaccgctaatgttcttatttctagaaacattctgttcatgacaatttatatattctttaagctgatagaagctttctctacagcttccctcattcctttttgaaccctcaccaaaatcacctttaacatttatatttctactaatattctttttaagtcatcaaggcttttcctatcatatgcttcataattctagcctccacccattacccaattccaaattccaaagccatttgcagactttttttttaggtattattaccccttacttggtatcaaaatgtgtgtcagtttcctagggccaccataaccaattaccacagactaggtggcttataccaacagaagtgtatggtttcacagttctggaggccagaagtctgaaatcaaggtgttggccatgcttccttggaaggttctaggaagaatcattgcctctttctacgttcgggtggttcctggcaagcctaggattctttggcttgtaattgtatcactcccatctctgccttcgtcatcacatgcacttcctcttccttcttatgtgtcttcatatggccttcttagaaggatacaagtcattggatttaaggctcatcctaacacaattgaacctcatcttaattaattatatctgcaaagactctatttccaagtgaggtcacattctgagattctggatggacaagaattttaaaggggacactattcaacccagtatgtgttcttacagacctctaattcttcctcatcttctcttttaggtgacaagacactaatattaagttgctatggtgatagtttatttatttgacctactatctgcattctatttcttttcaaaatgtgtttcttatatgttaaacctttattatgtcagactgtggcaacacctagagaaatctaaacattatgtttttgccaagatgaggtcagaaacagtaaaacattgtttttaagttattggattaatatgtctgcctgctactaactgtggttaaataataatctttgtttttattcatagttaattacatgctcaagttgaaaatatcaaaggttctttatctgattctgtgaattgatatttaatacatggtctgccatggttacctagcctgggatttgttactttaacacatcaatcaatggcaaagtcaatgtgtaagctgctagtgatttgggaagcatctttgtattcaatagtcttgtaccttgtttgtgattgaaggtcattctttaagaaaagaatgatatctaagactgtaaattcattgtactttctaagctcttgagagtagagatttgcaacatcaatatatagccaggctttacccattcgggccactaagactgatactcatagttttaattattttcacttgatgaagctaattccaggaatactattctttactttcttggctcttagaagatatgtctattttatcatttggaaacttaggaaacaatatccttttggtttttgtgcaggcttttttctcatcatatacttgcaatattttacttatcttaccttcatagtaatccacatactagggatattatatttagaagcttcatgtcccactacttattaactatactggagtgttatttcttgaggtttattttgaaaatatgatccaagctcctatttcatgtgggtttgttgttggctaaaaaaaaatcctcttcagcaccccatttcccccaaaagatatcatgtcctaatctctgggacctgtgaatgttaccttacttggtaaaaggacctttgcacatgtgattaggttaaagaccttgagatgggagattacactggattattgggatagaccctcaatgcaatcaccagtgtccttatgaggaagagataggggaagatttgaaaacagacagaaaagaaaaaggcaatatgatagtagatgcagagatttgagccgtttaaacacaaactgatttctaatccctggcctccacaattgtgagaaaatccatttctgttgttttaagccaccaaatttgtgtaatctgttacagcagcctcaggaaaataatacaggtacgtaacattttcccttggaaaatatgagatacaccatactcctaacaaaaatgtaattggctgctggatttatatatagtagttatgtttctcagtagttctatgcagaaaatgcatcctctgagttgatactgggtttcgagtaacattcctccactttgtccttaactgaaatacttaacctgtcaaattaattctgaacttccccatagaatagatttttaaattgggagactatttcagtgatgtcttttataaagaggcacatcttttcctacctaaatagtgtatttcagatttgccccctctgtaaacattcatatttctttataaagcctcaacttctgttcagttttcatttcacattataaattacagattaaaccaaagcttccctcctttatgggtgcaaaattgatggtataagtaactgttctctcaaatggctaattatatttctagttgcctacttgaaggtctaattagccaattgcatatgcttttgtgggggcaaggagataattggcatcctcaagcaggtaattagaaaagcaattattagtgcccacggctaattacaagaatgaaaattgtccccaccaaaatggtaccagtgtctactgggcagaaaaccagtccctggaaagtgacaggaaacttaatccatttggcagtgttagaatggcaggcagtaaaacaaatcatcaactagacctacataatctataagcaacctcctgtgagagggctgtcagaagcctttctaactgtggcaaagggctgcagttggggcagttgccctattgccaataataacctgcacatgaacttgtatccctgtcaggagcactgtgatcttcaaagttctttcattcctagaaataacgtattatgaaatccattctcgagtggcgattttttatgatgttgtgttatcacacacgttataaaataaaggattctgtggggaaagccacttgtgtttagttgcttttcaactgcatctgaccagttctttaagtaacagaacttcagttaaatgtttcagtgaattcgtcttttgcagaaagcttcctgtggttagcaggttttggtgttgaagtccctgcaggttttatgcccaattaagcctctgattgggctctttgttctttattacccaagtatttatcccatgtaaatgagaaagggtagaaataggcaaatttgttttatctgacagcaagtcaacaatttagctctcaagtaacaagaaaataaaacttgttgagaaagttggtactgtatctgaaaaatttaagtctgctgtcaagaaaaatgaaaaagcctgaatcgctgcatctcctgacacatttcaaaatggggatacatagcacaaattatagtgtgcttgatggtgctgttgataatagcaccctgcgctcctcccagggcaccgagcactactgctgaaagggctcaactgcgggggttgtgcgcagatagttgcctgggagagctaaggactgttaggtcagagtttccaagaatagagaaaatacgccagaagaattaatgatttaactgggaaaatgcctttgtcattttttcctattttaaaatttctttgccctactctgtattttcccatcattcctcctgcctagtcttagtcatttactttaatcaggaccccctgcttcctacgccagggcaaaatgtctagaactatgggaaaattttgcctcgaagtaaaagtcaaaacaaatgcaaatctgctattagagttgagcagtttaaatgctccagtacaattgaggattaaattctggaaaagggtatccaacataaatacacaaccaagaggttattttttttaattagccatgattgaaggatagtgaagaagaagattaaaggcattaattatagaagagacaaagaataagcagacttttcttaaaatgtagtataaaacagttttgttagccagagaataaagatatttgtattccattaaatattctatgcttttatttttttcagacacattttcttgtacatttgtgtatttcatgtgtttcccaaatcaattttgagatcatagaatgcatggtctgtcattgtctctccagagcaggacaatctgacaagtggtcacccagcctctacccagtggtggcccccaaagcagccttgttagtttaaaaagaaaaaaaaaaaaaaactcttattatttgaaagagccttctttccttgaattgacttgcttattctaacttccacccacagtttctgttccccagaactgccacagggaggttctgaccctgaataaatggcaacctctcagatatcaaaaggctcacgtactaaatctttcctccaaatccccaaggcctctacggcctttctgttacgattgaattttagctgatttaatatctgttcctaaacagtgaccaaacaataattcagttaagcttatatccaaccagaggatcattatgtaaatttgagtgagggtagagagagtgaaggaaaatgaaatattctgcctcatttacctttagaaacttgtaacttgacttaaaaaaaaaaaaaaacttttaaactgaatatattggtgtcagagagatctagaccagtatgtttttaaaaattccatgcctaaggtaatatttcatctgcttttctagctttattctcttttttctatcttctactacttttttaataagcttaaagtagaaagaattaaaaggcacctattttctttactcagtttcttacacatacttcaagcttcacatagatgttcgttagcattaaaaatgttcgggggtttttaaatgaacacattttctcttactctgccatctgccaaaccagtgcagttcctatatgatttatgtgagataacccagaagagtcagagacataaataaaaactaaaaatccatcagtggtaattagaatctgtctaatgacaatggtgatgtttggaagaatatattatacatgttcctgtctcaggactttttaatatccttctcttttttgctgaaaatcttttctcccccaggtccacatagcttacttccttacctgcttcaagtctttactcaaatgtcaccttttcagtgaggccttgcagagccagaccctataaaattgtgcttcccccttcctcatgccaacatacttctaaccaccaacatttcctgccttatttttctccataacatccatcataatcttacctatgctttttctcattattatttgtgaaatatatcatgtgtacaggagagtgtacaaaatacatatgcacagtttagaacaaacacctgggtaagcaaacacctgtctaatcaccacccaggttaagaaataagaagctccctgggtgttcggaaaggtaaccactgtttcaacttttatgatagtcattcccatatgttttcttattattttatcaattatgtatatttgtgaataataatacagactttagtcatttattctagttaaaacaacagactaagatatctggcactctttgtatatagatgagttcctagacctattccagaatactccaaaacttattctcagcccaagcaacttgactcttccttcaccagctctcttaactctgtctatttcacccccaaccttccatctctttccaacctttcttccctagtttggcataccactactagatgtttagattcttctccaattctcttaacaggacagtcttcacttttgatatgagtcagaatcaactgaccaaggtaatcaaattttaatgaaaataggtaatttctttcattcctgaaacaaatttaaatagttatagagtttctgctatttgttacctattctagtaacagaaaacctcatgcttatctggacagccaaactttttgttctctggtacaatcctcagagtgactttgctttgcttacagttatcccatgtacaatttccatttagatttattccaaagatttcagcaagcatactgcttcacagatgatctcactttgttttgataatgtgctcaatcatttcatatacaatcaaaatgagtaatcagaggttatgcaaatgaaactttatcatcattgggactgctgcctatttgcaagtatccttcatcctcatctagttgaagttagctattattctattctacagaattttcagtggaacaatgtccacctttcttttgtacgctacagagtccagagaactgtactcattttctttttatgttgttagaactagatgtatcattcagctataatctgagttctacaatagctgtaatcactgtgtcactggcccctgaaatgaattcttagattgggcaatcactacactatcaacatatattgggtgtagcatctaaatcttctgttgagaatattgccgttttacttatctaaaacagtatgcagtaagtgtagcagtatatatctaaattaacttcttttgtagcattttatcagtgttctgccttttctctacattggctgcattttaccagaaacaaaagttgtggagcagtaaattatccatagatagtctagaagctcttttgataaaggatattcaaaatgttatatgaaaaaaatataagtttttctttagttttttcatttattagcttcagcatttttcatttatttcttcattcaaagaacaggtttttaactgatagctaaaattattatatcctctgctcaatacggttaagttcaaataggcaaaaatatacacagaactctacttctaaaaatataactgaaatatctattttcagtttgaaaaaaaaatcattctttctagagggtacctagcttcagtggcagactgatccagttctttgagagacatgttattgccagatatttagaataagtagtatttggaagaatacaaatatacaaatgattttttccatataagtagtaaaactttaaggagatgctttaaagaagaggcttaaacattttttcatcactaccacaaaataataatttcaccatttttaagggttcggcactgaactgattatgaaaagaaagtcttgttgcaagacttcaatgaaaataaaatatagtatttttaataattgtatggttagtcattatctgtgccctactgatttttggtcataaggttatatttgaagaaatgtcttcttttatatattcaacttcaactcaatcatgtaataaacttatctggcatgtgaagaattttatgtagtctctcatcatagaaaatgatggtaggttgcccatctggcaaaggttgtaagttcagatatgctgatgattattatctgtgttaaagcagcctcaacactttccaaaatatattcatataatagtagctcattatctatattaaaccacaataaagttaatattaataccatggattttataaaataactttgaacgaagctgaaagcttcatttagtttaataataacgatgcttgaggaccactttggttttaataaaaacatggaaagtagcagatgagaaagaaccataaagatgccagtcgaatagctgtaataccaattagttggcaattgattcattcatcaaatatttattgactacccactatatttatgtaccatcacaccttggaccaatagaaactgaattaagttttaaaactacgatgaataagggtgcaaatgaggaatgactgattgataatcccaatgagtgtgggatttttctttgtggtgggtgatgaaaatgttctataattacatgacaacaatggttgcacaattctgtgattatactaaaaatcaatgaactatgtgcatccactctaaacatgttgattttatggtatgtgaattaaatctcagtacagctacttagaaaaacaaagctttattgatggaagacaacaatgtcataatgatattgatcataaagttattggctctcagccagtgttgaacaagtagacaagtgtgcatcaaacggtttatgagacaatcctaaagaagtcggactatttggatttgggattaacatttgctctactttgcatgcacaagaaaactcaggccttgtgacacagtatgcatgcctgtttttaaacaatcacaaatttacaaaaaagtatttacaagtatatataaagaatttttttcctcataccatttcagagtaatttgccacctgacacccttttatctcctaatactttgatgtatatctcctaaaaaaggaacattttccacataaccacaatgtagccatcaaaatggagaaattaacactgatgtacgactaccacctaatcctgactccattcaagttacagcaatttttccatttacagcaaaattatagcaaaagaatctagtttagaatcatgcgttgcatttagtttcctcagtatacaacagtttcacagtctttccttgactttcatgggcttgataattttgaataattattttataatggattttagaatgtccctcaatttggatttgttcagtgtttcctcatgattacatccaggtaatgtaatctttagtggtgatattcacttcagcaaaagtgattctatattcttttcattgcatcctattgggatgtgcacaatgtcatcttgtgcattgctgatgatgtttgctttaatcatttgcataaggtagtgttttcttcaatataaaattattattttcctttgtacaattaataagttctttatgggaaacactattaaactatgtaaacctcccattccttatcaaactttcaatttaatatttccttatttatatgacaccttcctattttattcactgaataataatctgttactatcattattttgatgctcaaattgtcccagatctgagaggcccctttaagatggcttctgtgtccttttgaaaagtctctatattctttgagcatttctttactttctggcacaagatattccagtctcatcttgtactttctatgcctcagtgatttctccagaaagtcctggtttcttttagtggaaaatggtatttagaagccacaatctgacattaggtgtgctcattgctattgaggtattgctgcttccaggcctctctgtagacagagctggaaaacatagctatgtatatatacatttacatgtatatttatttctctgtctatatactgaacaccatgagtttatataaatggctaaaattctgatccagaatccaaggttcatttatctgttcccatatttataactcctttacctaattaggtgatgaacccggtttccattatccttaatgtattgagtcaaaaataaagcctccttttatgtgaccagtctcctggtctcagctttcctcccatccccagtgcagattccagtctcccatgtattagtccgttctcacactgctataaagacatacctgagactgcgtaatttataaagaaaagaagtttaattggctcatggttctgtgtgctatacaggcttctgcttctggggagacctcaggaaacttacaatcatggtggaaggctaaggggaagcaagtgcatcattacatggctggcaggagagggagagagacagcaaaagaggaggtgctaaatgctttgaaacaaccagatctcttgcaaactctatcatgagacagcactagagggatggtgcgaagtgctaaaccactggaaaccacccccatgatccaatcacctcccaccaggccccaccttcaacactcgggatcacaattcaacgtgagatttgggtggggacacagagccaaaccatatcatcccccattcaatctccaaaacccatgctgggctggcttctgccccacacggatccctccttatcctgctaatgcccttgtgctgagtgccagatcactcccacatctagcttccctcctcactctgcctgggcacctgaactccaaatccctgtgcagagttgtcccctgaatgcacacacatctcacctcactcaggctttggatccccacatgggccacaacatgctgcactctgctggctctcagacacttcatgccaggctgcctctctgtggagatgccgtcatcaccctgcttgggacagctttaaaacaggcaactgccatatgcggttgccttttccaccccactcatgttctgatgccacgtctgccctccttcacatgtacctcctcaccccaatggggctctgatgcgtgttctggcacaccatggtttccccttcccacctaatctggacacctaccttgctctgctgcccctaatggctttaggactaaattgttgaaacaggtaagcaaaaggaagcaaaagggaaggggaaggggaaaagctcatgcaatattttaacttaacacatctttctcacccactggactgaagttcatggccgaaggaaccacattttttccatctttttattctcagttcttaacaaagtatctgattcatagaggtaggtagcagtgcaataaatgcttgttaaattaacctcattcaagtggaaagctgagaacttaagcaattccagtctttggctcttatcagtgatctcagtcaaaccctttgagcattattttcgaaaggaaagtaaatcataagcagtttggccagttgtcctccaaagaggatctttctgaaaaaatgtaacaaaatgaagccttttcatgggggctaacccttctatatacaatttgctaacaatataaattaaatctattgatttattttgaaatcataaacttaaaaagagcaatgttcattagatgtagagcttttattcttaattagtatcaaaaatcattgatcagaattatgccttctttcttccattttcataatataggcaagtgaattagtttccatatagtttcaaccttatagctcctccaagaaatgtaataaacaaaaagataattaaatgatatttggactgaagcattacataggaataacaaacataaaggctttattctaaaatatagggaccttgacttttagttcctgttaatggcaggaacaagcttttatttgtgtcttttctgggaagtttgttcatttattcaaaatgtagttattagacaactcaggccagcaacataatttgtggggcccagtacaaaatgaaaatgcagggcctcttgttcaaaaagtaggaaaaataggcctttaaaagtcctaaaatatgacaccttttcctttcttccgtggtctctctcctggcctttcgaatagtgttttttaatttgcaatttaattttacactcaggcactgggatactcaccaagcaggtatcaacttttataggcacctgaaggctcacctggggcagaaggaagggctggggtgcaggcatccacagcccaccaactgcaaggcttcttctgccaatttttggactgacactggggatattagaatgaacaaaacagacaaaaagtccctgcatcatggaatgtacatgtcagcagaagactcagttaaaaaaaaaattgtatgtgtgcacgtgtgtgtagtatctgttaggtagtgataaaccctttgacaatcaataaacaaagcaggaaagtggggtttggagtactcagtgtagtggatagaaatgggctccaatttgaagtaggttaggaaagccttcactaagaagatgacattcaagcaaagatctgggagaagtacaggagccagccatagggctatctgggctgagatgttgcaggcagtggcaggagcaaatgcaaattcttctcagtcaatgttgcaaatacttcagtgagacagtctaattttctcagagacctttttttttctttttttgagacggagtctcgctctgttgcccaggctgcagtgcagtggcacgatctccgctcactgcaagctctgcctcccgggttcacgccattctcctgcctcagcctcctgagtagctgggtctacaggcacctgccaccacgcccggctaattttttgtatttttcgtagagacggggtttcaccgtgttagccaggatggtctcgatctcctgaccttgtgatccgcccacctcggcctccccaagtgctgggattacaggcaggagccaccgcgcccagcctctcagagacttctttttactccacaccccacctacctttccccacatcactaatcttgtttctggaatttgttccaccttctcttttccaaatttagttagcctaggtgagattcctgctctctcacctgttacaggaggcttctaacttcctgcctcaaagctctctgctccccataccactgcctgttgccctcagcactgctggagctcaagtctcaaacataactgactgtgtgttcttactcagaagacccattgtgtggctttcatgcaccataccaaaatgcagaagtatgggaccctatgttatgttcagaaatgccataaaatgatctgccccatatgctgactaaactggttttgtcctgttacagaccatcacctgctcatctacacctccatgcctttgctcatcctggaggatatttgttcagtctcagaacttgagggctaacttttcattccaatttcaactccaatggagttcttcttgaaatgtttcttgatctctccaattagaataaactacttacttggtttcagttttacttaaatatctctctgtccaccaagtaatgaggttgctttttttttcttttttttcttttttcttttttttttttttgagtcggagcctcgctctgttgaccaagctggagtgcagtggcgcgatctcagctcaccacaacctccgcttcctgggctcaagtgattctcctgcctcagcctccccagtagctgggacgacaggcacgtgccaccatgcctggctaattttttaatttttagcagagatgggatttcactatgttggccgggctggtcttgaactcctgacctcgtgttccgcccacctcagccttccaaagtactgggattacaggcgtgagacaccagtaataagctttctttacgtcggagatcctgtcttatttatctttacatttataatacctgtctctttgctttgcacacaatatggacttaatacatgcttgttgaatttaacgttattaatgcaactcatattattaattgtaatggtagtaaattctacaataacacacctggcaataatgcaaattagaatagcttgaattgaaacatggaatgattggaaagcagctttttctcctctacctgattccttttctcaggaaggagaagggaacatagaggcctctccctcatggggatgctggacagggaaaaatcagacaatcctatttcaggaaacagagaggtgggggttagttcccagtattctcccagcccattctctctggatcaggccaacaaaacattcaccaattaacgaagagattcctggaatcacagttgctctcccagaagtcccagccaggccccagaattctgcccatcaatttttatgttagagcagtcaccactaggtggtgccgaacttcagcccagggtaggtgaaatttgcatcaaatagactcagaacttccagatgtccagttgcacaggctcaccttggccatttagctaatctcataataacacaaccctacattttacacagctgaatttctggggcactacttattgcattatggcagttttgttgtatcattttctaaaaatctttcaatatcagatactctgccagccactttacaggctttatctctaatgctcacagtaacctgtatggtaatgggtactgatacttttcttcttttagtaaagaatctgagctgggcatggtggctcgcacctataatcccagcactttgggaggccgaggcgggtggatcacccgaggtcaggagttcaagaccagcctgaccaacatggagaaaccctgtctctactaaaaatacaaaattagctggacgtggtggtgcgtgcctgtaatcccatctactcaggaagctgaggcaggagaatcgcttgaaccccacgagatggaggttgaagttgccaagatggctccattgcactccagactgggcaacaagagcaaaactccatctcaaaaaaaaaaaaaagaagaagaatctgatgctaagaaaagaaatgtctcttgcccaagagctgtgccttgtacagctaagtgacaggtgacagacctaagaattacattcaagcctgtctcactctaatgccatacttgtcatatttctgctatacttcaatttaatgatcaaagaaaggaaggaaagagacagtggagaagaaaagtagggaaagaaacagaaagagaaggggagaaagatatgtttgacagaaaagtaaatgaagtatgttaccatctgtttttttcaaccccagaggtctgattcccccgcaggaaagagttgcttctagcctgtcctttatctctgcacctgccctgcttatctcctgcaccagaggctcctaccatgaccattaatggactgagtttttgtgtccctacgaaatgcatagcttgaagccctaacccccaatgtgatggtattaagaagtggggcttcaggaaggtaattaggtttagatgaggtcatgagggtgagttttctctctctctttctgtcatgtgaggacacagcaagaaggcagccatctgcaagccaggaggagagtcatcaccagaacctagccacacaggttccctgatctaggacttcccagcctccggaactacaagaaataaatgtctgttggttaagccaccccagtctatgacactgtgttgtagcagtcagagcaggtgaaaactgtaacttgttattctctaaggaaaatacaggtcttcttctcaggcctgtcttcagaaacaggttcacatccccatcttccagtcattgaactaaatggaaaagtttttgtcttcctagtcattgtctgcacctaaacacaggcttgcccatctgtagtcctagtctgttccttttctttggtgaggataacccttcctgtcttgctttaacaccctgtattttccgttcattagtgactcagacctctgataatggtatactagttaaccccctgtctcgtctgactttaaatgattgcctgttttgaccttgaggaaatatgagtccactaggaactacaatctttatggccacttgaaaatctttattccacttaaggtggaatagggtaccttgccacagaggaaacaagtaaggagagaaagagagtaaagatcagtgagaggaagagaaaactaaaactactagtataaaaagttctgaaatttcagcaaattattttgcttccaactgtacttaaccattctgccctttatttgcaataaaaatattggggtattattatctttgaaatgcagattatgtggttaaccattgttcactttctaaaccctgtaagtatttaacttgtggatggggaatattgtttgggactgtattggttgcaaaccaaaatgatctacactcacacagcttagtgtcaacattaacatgactttactttttagctgtctttgttaacatgactttactgtcctactgtcttcatcaacatgattttactattccaagaaactcttgccttggaagataaaaatagcaaatgattttcttgtccctttcagaaactttttgaaaattcatttaaaggaatattaaataattcaactttcacagttagcatcagatgaatgtttatgctccaaaattcattgtgaaaccttcagcttgtgtgtcttccaaacttaaattattatgtagtgtcttaaccaatgttaagacattagtgtcagcattactgacacacaatcaaatgctcccctatggaaaaacttgccttaaaaaaaaaagaaacacacacacacacacacacacacaaaacaaaaaaaaacagaatttctaccttccgccccccaccaccacacacacacacctaaattctcttaaatatcccgactttgccttcctcctcccagagactactaaggccatgtcaaggaagctgtctcccctatggtggtaaacaatgaactcagctctgtcatatgacaggctataaaaagctgattttgttgatattctgggaaagctaccattcagcaggcaagtgattgaagccatttcctctcaaacttatgaaagtaaactaaaggtctgattctgcccagggaggaagtttctccactctatcatatagaatccatatgtccatcatacttttatttgaaaagaagggatgctaactctcagaagcatgtcatagtaagcacagaagtggaaaaaaagaattgatcatttttgtgagggaaaacttaatgaaaaaattacaaaatcattataaatacaattcatttgaagttatgttttgagattacattattttctctctggcatttagacacctaaaattcactttaaaatatgttggtgaacaaatctcattctccagaagtacatttttaaaatggcaatatttcataataacagtataaaatgaaaataattgactatctcttgccttgtgggacttggcttttagtctaaatagatatgaaacaaaatgacattcatctatatgagacgtttgttaacttaaaagaaattaagtcagaagcctataaggctaatccataaatcagcaaatcagataaattagtaaaacttttccagaatattatccaggggctccttactcctttgcaatttgttacctgttttacatgtccttttaggaagggttcatttcccattgacaggcaaaaagaatatatgaaattagaattttcaacagcttgcaacatttgtgtcatttttgatttaacaattttagaagacttgttccaaaattacacctgaatttcattttctttgtagttttctaaaatgctgctactatcaggacataataaaagccacacagccagtactagaaatgctgtcatgtaaccactaagaccacactaaaaggcaaaatgctgcagctgaaagtatttttaatgacttgaaattgcttggaatgctttctagaagtaaaagggtgcagatttatttacctagtatacttacctaaattaatttggcaagattattttggttcaaatcctcattcaataaaatttatgttaatatttttaagtggtttttttcctgaaggatataatatattgcattaacacaaatttacaacagtcatgaaagtaaaaggtaaattaagccatttctgaaatatgaataaggactacatttttaaatagactacatttatgattttatgtgaccttgcagataaacatcactatgtaaactgttaatgagaacaaatagaatcacattctatttttagtttttcctgatgtatagtttccattagagatatggaggaaactttattcttgcataatttttgttttagaagtttgggtttttttgtgttttttttttaacattttaagcaaatgggctttttatatatctttttgattcggtacattccttactacagaatgaatcctagtgaaattctcactataggccatttttccatgtttttttcttttatggaaattttaaccatggttactaacatataaataaactcttttaactgcaaagtcagaatgggtatactttgttatgaacatattaacttattccagtttcatgtcttgtgtttttctgcactcattaacatctccttggtacttgggatcatggcctggccaatacgcataaagatgacgagatatctatggactacagtacatctgtttaataattagtaattgttatgcattgtaaatgaacgattttgactcataccactgacatttaattagtttttactatattccaggtacatatgagaatgtcacataattatcttctttaatttttacagtaactgttatcattacttcagaaaggaacaaaactccatttagagaggttaaatagaaggtccaaaacatgtagcaagtaaaaagtatccagaacttagatccaggtttgtatactactccctaattggggctcttaactactttgatgcattgccttttaaacttactttcttgattatctatttgactaacatctccccaggacacacaaaatacttgaattcatgctattatggcctgaatgtttgtgtccctttacagtgtatatgttgaaatcctaaccctcaatgtgatggcattaggaatcagggcctctgggaggtggttaggtcatgaggttggggccctcataaatggcattagtgcccttactaatagagacagagacctggctcctgctctttgctctttgccacgtgagggtacaatgagaagacagccatgtgcaaagtaggatgagtgcccttgcaagacactgaacctactggtgccttgatcttggtctcttcagcctctaaaactgtgaaaaataaacgtttgttgtttaagccgcccagtttatgctaaattgttatgatagcctgaactgacggagacacatgcgtaccacaaacaacaaaggctcaaggatccttaaaataaaaaccaagactttcagtgggttgtaacatcacgtagtggaggtaggtttcctctcctctatacctctcccaagtaggaaacatattaagatcacaggggagttaattggaactattatttcatatgtaaagaatgtattctttataacttcttgggaatatatcttaatttcttttaaagaagattagtctaagttatagtttagtctatagttttgtaggttagtctaacaacattttcgttaagtctaaagaataatttgcaaactatgtgtatgtgctacatttgtgtattgagtgggtgaagatcgagttcagcacagcatgcctcttaggtaaatatgtaaaattctaggagttatttttcaaggggtacaattctacacccaaacattcccctcctaattctacctcctaatcgtagaagaagcagccccttggttatttagcccaagaatccaatgtgacttatctgtaatcctattagtccattctattcccttgatattgggaagttttgcctgtcccaaaagaggccattcggaggttattcttggatgattcactcacttgtgaaagcaaattgtgttggcttcaagatgctgcatttttttgtaaacaatgccatgacttttacatttctttacatcttggagctacccacttctgcaggtccattctctctctgtcaccatttaaaattatgtaaggtaagttttcataaacccgtaaaataatggttacataaattggaacttcctaccactcatatcttagttgtattaaatcaaacatttactactatttccatctgtttcactccatgacagcatcacctacttgactctgttatactaagagttcagtgagaagagcatcagggagcttagttctatgtagtatcacagaaccaaaaagcaccttaaacttgtcagggttctgtttcttcagctgtagaagaaaccagggttagggttgggggttatggggaagataatacaagtacaggtaggcagcctgtgtgactaaaagttgtatctggtatgtttgtcacttagggacttttatggacctagattctaaaaatcatcccaataataaccttaaatcatgtcagaaaactctacaatggaatagatttttgcattcagaaattacgtgcattttccccagcatggtatccacttacctaacactttatgctacataaaacgataaattatctagtgtgatctaaagccatcagaaacatttaaaagttttatagtacagtattttaaagtttactaaccattatataaaattaataagatagtttatacagtctcttgctttattgattgtgggtaataacctgtagatgggaatatagtggaataatgtgcctaactgcctttaaaagaacttacttaaacttcagtaatttatttctgtgtttcttggattccttttacttctgaagtcttagtgaggaacggtcagatattgagttgctgtattcactaaatattttgtggagaatttctttaaggaaagatgtggattttaatgcataaattttttagacagactattgaagttgaaatttcatttcaagaggcagtcagctttgtttaactctatatttttagtatccaaagttactgagccagactttgctttaattaattactataggatgtgaggcagttccagtgctgctttttctattaacttgcaatttcctgtaggaaattaataaaatgaaagagggggtggccggcaagaataaatatatgctacagttgcaagtcactaaaattcatcagaataaattaaactgcacaggtttcctttttttataattctataaagcttctcaattcttaaggcaaatttgacaaagaaacagggccatctaaaaatgatcaactttcatataatatacattaattaattgattagaatatgaaatttgtcagatcagtgttgtttaatggttaagaaggtaaattctagaaacagactgcctgagtttaaaatctggctctgccattactagcatgagactttgaacaatttacttaacctgctgtacctctttatgtttaagatgcaaattataataacacttatagggttcgtatgaggattaaattagttaatatgcatagtacctggtatatacaaagtactacacaggcattaacagcaattagcatctgttttttcatcagtattaacatttaagaaaaatcatcttactttagctatccctttctgcaacctctggagtcaaatcttaaggtgacaaatttaagtttttaaaatatttgcaaattttgctttgtttttctgagtcctttttaagtgagttaccaggaactccaatgaatgcatgtcgttgtactcaggtacttttttttttttttttctttgagatggagtctcgctctgttgcccaggctggagtgcagtggtgtagtggcatgatctcagctcactgcaaactctgccttctgggttcaagtgattctcatacctcagcctcccgagtagctgggattacaagcgtgtgtcaccacacctggctaatttttgtaattgtagcagagacggatcttcatcatgttggccaggctgttctcaaactcctggcctcaagcagtccatctgcctcagcccctaaagtgctgggattataggtgtgagcaatttcacttggcctactcaatatacttttaagtgaatactatgggtaccaaattcaagtgtctgataattttaccccatgagtaaaaggatttctcttgctgagatttcagaaattgttgagaaaatatttggaagaatgttagcaattgaccaggatataaaaagaaacacagaaattactcgcatttagatctgcacctcaaccacattgaaagggtggcaggattttcagaatgtggttgccttttcattgtcatgcttatgttcattctacaatcaatatgtattgccactgaaataaagatataatacaagatagaattaaggcctactgctttgactctattgtttatctagttaatagcgttaacaaattttagttctagcttcctttgaactgcatgtaaatgctgcctagtcaatgacatacctgaaatagcttcttgttctttattatgtgtttatgtgctcatctgagcgtgtcttgttactaggactgccttataaaagtcggttttaatttcccgagttaattaaaggtttctcttacaattacagcctccctagttttcaggggtttgttctttttgtgtgtatgtgaagtggggaagaaggtagttggaagagtactaccttttatcattccatcttatatgatttatcttcgctgtgtgtattattcacctattatttttcattaagtaacaataagtgattgaaacaaatgttaataaaatgattaaaatatatttagtaacaaatttatctgtttttccccctttctagtactggtttaagtggactggagtgagaaagacattattcgaaagatgttgcaaatttatcgtgttttcatgttggaaatgacataaatgactttgtccaaatgatgtctttttcagtgtagaatacttaaaccagtgctaggaagaaagttttttattgtaagaaagtagatttctttttattataagtaaataaaatatcctgattatggatatttcataattcgttcattcatcagtttatggacttttggcttgtttctagtttggagctattatgaataaaagctgctatgagcatgtgtttataggtcttcttgtagacacatgatttcatttctcttacgtaaaagtccaggaatagtactgctagattgtatggctaggtatatgtgcaactttatgagaaactgccaaactgttctcaaaggggcggcaccgctatgcattcccactagcaatgtgcaaaattttcagttgctccacacaccattaattcttgaactagtcagcatttttaatgttagtcattctattgggtaccttatggtgatttgtttttccatttccctcatgacttccgaggttgagcatcttttcatttgcttattgaccactgatataactttggcgatgtgtctgttaattttaatgatgttcagtttattgactttttctccttttatgaatcatgctttgatgtcaaactgaataattttttgcctaactcaaggtaacaaggattttcttatgcttccttctaggagttttattgcttttattattatatttaggtctgtattgtattttggcacatgttttgtttgtttgtttttcttaatgttgtatgtgataagggctgaaggtttttttcataagaataccgaattgttccagcatttattttgccaccattggattaccttaaccactttgttgcaaatcaatcaactatatatgtatgattctatttgttgacttcattctgtttcattgataaataggtctatcctaacaccaatcccacaatgtcttggttattgtgactatattaggtcttaaagtagtgtgaagcctccaatttgtacttcttttccaaatttgttttggctattctagatcctctgcatttcccgtataaattttagaatcaactttttcaatttatcaaaaaaatcagattatgaatgagattgggttgaatctatggaccaatatagggggaattgatatctgaagtcttgtgtctcttctaagctacaagttaaataatattacctcttttatttaggttttctttaacttctgtcagtaatggatttttagtgaaatattttaataaatttgtacctaaatttttgatactactataaatggtagcttttttcattttgatttccaattgtttgttaccattgaatactgaaatgcaattaatttttgtggatttatatttttatcttgtgacattgcaacactcaagttattaattgtagtagcttttttgtagattccttagggtttcctatgaaacaatattgtcatcttcaaataaacacaattttagttcttcctttttcatctgtatgcctattatttcttttacttgccttgttgcactggctaggttgtctagtacactgtggaattgaaacgattcaaacaaatacccctacattatttcatatattagggggaaacattcagtcttttaccattaagtatgatgttaacttcaggttttgtaagatggtctttatcagagtttaggaaattttctattcttagtttgctgagaaattttttttaggaatggatattgacttttaacaatatttttcttattttttgagaaaatcttgtggattttacttagtatagtttgttattatggtaaattaaattgatttgtttttccaatgtcaaattgacattgcctttttaggattaagctcacttgtcatgacatatgttttttgtgcatggctagattcaatttgccaatttgtaaaaggatttttactgagatgttgataaagtatactagtcagtaatttttattacttgccatgtcttttgcaactttaatatcagaataatgctggtttcatgaaatgactggggacatgtttcctcctcatctgttttctggagagtttgcatagaattgatattatgtcgtcctcaaatgtatttgatagaaattgcccactgaagctgcctagtccttggggttttctgtggaatagttttaatgacaaattcttttatttttccataaaagaacttgatggtttttatttgacctactaaccttcggccagggtaattttgacagtgtctgtaagataataaagtggcaattatagtagtaagtttgatttaaaacacctttaacataaaaaagaatacttgttaattcttggaagtaaaaccacaagtgtttatacatgtgaatatatataatattctttaataaattctatatctttagtagatatatggctgttcaagttatatagttcttgagtgagttttggtatttttagattttccaggaatttattattttatctaagttgtcaaatttattggcagtctcttatcttctaaatattcccttattattttttaaaatgtctgtaggaactatagtgatgtcttctctttcattcttgatatatgttgtttctttttcttggtctgtctggctagagatttatcatatttattgatattgtctgagaaatagcttttgggctttatggattttttcctttgtttttctattttgcatgttattgatatttgtatctttattatttccttctctctctttaggtttaatttactattcgttagtgtcctaggagggaagcttggaacattgattagagacattttttctttcttagtataagcatttaatgctataaatttcccttcaagcatcctttagctgcattgcacaaattttgacttgttatattttcatttttattcaattcacaacttttttcaattttccttgtgactatttctttgatctttggcttatttagaagtgtgttgtttctaaatgtgtcacaattttccagatttttaaatttatttttagtttatttctattttggtcagagaatattactctatggtttttatcttttttaatttgttaaggtttgttttatggctgagagtatggtctgtatggtgaaggattcatttagatttgaattgaaggtgtattctgctcttgtatggagttcttgaattgtcagttagattagtttcattgataatgccattatgtgttccacatacttagttctatattcttactgattcttcctcagagaggagtgttaaaaatctccaactataattgtagtcttatttatttcttctgtatattctatcagtttttgcttcatgtattttgaagctctgttatctttaagcacatacacattcagctgtctactattagctagaagctgataggtcttcttgattaattgacttctttattattatataatgttatacattttcctggtactattccttgatctgaagtcgtctctttgtgcctttaatatagccactccagctttctttctttaattaaacatttttagatttcttttttattatacaggtaagaaacatttaattataaaaatatgtgaaaatttgaaaatactgatagtcaaaaataggaaggtaaaatcagctgtaagctcactacccaaaagtaatcactgttaacaactttgtgtatatacctatttttaaaagttttatttttatggtaaaatacacatgacataaaatttactatcttcattcttttttagtatacagttcagtggtattaaatacattcataatgttgcacatccatcactccagctttcttttgtgtttgcatgaaatttctctacctttttatttttaatctgtgttatatatttatatttaaaaataggtttcgtatgggcaactatagttggcttttacttttgtatccaaaatgacaatctctaccttttaattcatctatttagaccatttgcatttagtgtaattatcagtatggttgggataaaatctattatattattatttgtttacaaggttcttgtttggatcttgttgtcctatccctgtagtctcatacatatttcacacttcttttcttctactctacatgtagccttcataagcttattctaataccttcaaagggccaattttttataccccactgatatttttacaagctattctctgcctacttaagcagacggagttttgttcttgttgcccaagctggagtgcaatggcacgatctcggctcactgcagtctctgcctcctgggttcaagcaattctcctgcctcagcctcccaagcagctgggattacaggtgcacaccaccacacccagctaattttttgcatttttagtagaaacggggtttcaccatgctagccaggctgcctcaaactcctgacctctgttgatccacccacctcgacctcccaaagtgctgggattaggggcatgaaccaccgtgcctggcctttcccctttttctcaaccacacttaacaaattattgctcatccttcagatctcagtaaaattgtattcctctaagaagcttttcttatatttcaagtctagagtaggtgcctttccctactttcgcttcactgtccctagaattaatagaattaatatcaatattaattatttaatttaaactgtgaatggaagaaagtatgctagagagtgaatatggatgtcttctcttcctttataaaaggagaattccctagccagattgccatgacagcaatccattctttcacactgttagaatgtcattttgaagtgcctctgtggggttcttttgcccaccctgcctgggatcatctaaatgacgagttaataggtacagcacaacaacatggcacatgtatacatatgtaacaaacctgcacgttgtgcacatgtaacctaaaacttaaagtataataataattaaattaaattaaatttttaaaaaatgagagaggtccctgacatccctgcagggatatgggttattatgtatagtctgtccaactataatgttgcatttttgtttcattgtttcttagagattaataccccaaagaggggtctatttcctgtaatttctgtatttatcaagctgaaaaagcatgtccataagtttagaaaactgaagctgagatgatgaaaatactgtgctgttgtttttcactaatagttgcctgattatatcactgaaagaatatcaaaaactgattttatgctattgcagtaagatagctgctggttgtacttggtatccttatgaaacaacattcttttggcattagattatcactaacatttaaataaccttctctaaattaatttttaaaatttccacaacaaagtgcatcaccattaaaacatcacgttagtggcaattataaaatggtattaaataatagaatagatgcctgaataataatatgtagttttttaaaatccttaaaagataaactacagtaatgggtattgatgaaaaatgtggttggtctatttatagaaaagctaactatagcagacatttttaaataatattttttatttctcctttaattaagtttgttcagacattcatagatcatcttgtacctacaaaaagatattatttgacaaccaagtacactctgaaaagaagaactttataagttatcttttttaattttccttcattgacataatgacagtgaatctcattatgttggtgctaagaatctaccattgtgttttgttttatggaaagaaaatttaaattatgtcgtgtttaaaaaatgagtaaagtaggtcaacacccagctcactccctgacatcacataaatgtaagattaagtaagtgaatgacctaatgttcagccttctaaatattcctatatttcaatttagggagcaaatatgaaagtaaaattaatggatcagttcatacttttaaccttgagtcatgataataactgtattgaagaaaatatcatgatcttgatatggtaggcaatggcaagttacttgccccacaaaatatttttaagtaaaaaataatttcccaagagaattttcaagactcattattggctgaagatcagaatattccagtggttcctttaataataatacttttatatactcattttaatcaaactatagagttcaacttttgaaagcaaaagtttaaattttgaaaataaatttttgaaagtacaagaagatagttatatagacatatgtgatagtgagttaccagtcccacagagatccaagtattaaaatgagcgattgctcactggacaaggcagactaaatgtttttttcctaagggtttcttcttaacattcctgtctcaggaagggctttaattgacagggtaaggcagaaggacaaagaggaagaagcagcactggtttgatcattgacaaagcactttcattttatgcagcctatcttactgtccagcttggtcagaaaacacaaaaagttagtcatgagacctgagtttgagttccagctcttctacctacttggcataaaatctgtggcaagttaccaagtttctctgggccccagtggcttaatccgttaaaaagatgattgtaatgtctacaccacagaattactatgctacctaaattccataattatgtgaaatgaacattttcagatggcaaagaatattacatatcttagtttcaggtaacatacctgatcaagttagaagaaaatctgaggagcacatttccaagacaacccacctacagatttctgatatgaacagacagtggctattaaacaaataaacaaacaccacaaaattaatcctaggtgatggtagtatgaaatgcatagtttatttctatacttatttcaggcttaacttattctcacttctaactgaatataatagagtctcacaagctaagacctggggctgaggatctcctcccgtattgtgagaactctacattgtagaaaagtctagttttattatttgaaattaatagacctattctgttcatgtgttaatatttgaattatttaaagtacctaaaacgaagttgctattgaattttaccaccacagatcaacacatccactggtatgtggtgtgtgtgtatgtgtgtgtgtgtgtgtgtgtgtgtgtgtgtgtgtgtattgtaatatagaatatgctaaattcataagtttccacttgtgtttttttcagtacttttcttaaatcacaaattacacgaagcttaacaaacatccaaaaacactaacctaactggaaaatactctaccatctttaggtcaatgttagtggactgtcttcaagtggaggttgacttcagaatagaggctcttttcatttttaatctatcttttctccttggtcttttatcaggaatgatgtaacaaaagtatatgtatccgtgaatagaaatgtgtgcaaagaataagtggcagtagtgggagaagcctctagatctgtgtctatttagaaaggctggaaaataagaaaatagtagaaccctgaatatatgctatacattttatcttctcagtgatttcctgccttataattctttttaaaaatcacattatagcctcaaattgccaggtaagaggagaataagtaggaaaccaggctgatttcataaaccttcagtattgtcccacataagcatgcattttgggcctgattatgttctctgcaaacactgtccagaaacagattcagtgaattacagtcttaggactaaccaagacaattttgagcaaaaagaaacccctctctaatgtgacagtagaacataagaaacatcagtgttatcactgaaattcagcaagtgcagatgttaatcactgcacatctagctctacctgccaaattggtcagattctttgagtctgtggccacacaatgtgatctgccaactgcagtttgtcacagtctgccactttgttctgcaaaagaagactgcctacattgtatcactaagttcttttggctgttactccacgggaatgttgctaaacaatgagaaatccaatgaaacattccattggcttaagaatcagatattgtataagtcgttcattcattaattcaacaaatacatagtgagaagttactctgtgccagataccggggcactcataagaatttctatagatttaacatcgttagtaatgtatatatagctaacaagtaaggccatatattgtcattagccaatgtcttatcatcagggacagacacatacatatattacagaaggacgtgaagaagagtgagcgacctgtttagacacacttataaggacacacacagacacacacacacacacacacacacgtgaaggaagaaaacagccttacctgttaagtttcagtcctctactacgcactttaactattttcctattttttagcagaaccaccttataagatgttaaggtgtttcttcacgtaatgcctgtctctttcatctgtatcatatgccctcatcactgtgaggaatgggagaaagaaaattggtaactctgatccatactatgcctctgaaatattttagcaacagttggaatagaatcatgtctggagctatgtgtgcgttagaataggtatttaccaaaccttatttttctatttcatcaaatagaaattctgcttttttaacctaactgttcctcttcctactgcattgctggataatttgcaagaaaattgattccctaaacccaactctcaggctagattggaaataaagagcttatagacccttcagaatccccatgcctttagaatccccaaggcctccatctgcatgtttacttacacaaatttggccctagagccagtgaaacacagggacataaagacatcctcattaaaaccaagaatttaagctccatctcgtggtcggatttgaatgaccaagaacataggttttccttgattctttgaattgaggatcaatatgattatcctgtactatttaaaaatttttcggaaaaaaatcatgaaattatttatgaggtcataataaacatggattacattcccagcatgcatttcatgaggctaaattatctgaggagttctagcacctgaaagaccataatttatttaaccaatatttattaagcactaagtataaaatatggcactagggctcaggcaaaaatgaatgagacacagccttttatctgaaagtcatttacaatctaataaagccagatgcatacatatatgacagaaggacatgaaagaagagtgagccacctgtgtggacccactgagaaacacttaagggtgattatgttgaggtacaccttagcaatcttaattttccttcttctacctttttgtttcactagtaaaaataaatcacctcttatacaagaaggaaaagaaactgtttcatgcgctgaattaacacttagcattaaatgcctatgctaactggcccataaaaaagtagttttttttttttggtttgtttttaattgagagatattttaattgagcctatgacataggctactttcccaaatacaaaattttagcatatggctttgattttacgttgtgtttttttttttttttttctgttttaatgtttagtcacacaaacttgaagttatcgtggctccaacagaaaattctagatgtcattagccagtgttttatcatcagggagagactattttacaacaaaattccaaaacaaaacttttcctttattacacagtactcgttctccattccctcctcttttagctgctccattagtctgtgcaaattgcctttcattttattgctttccagggcttctaagtgcttgtttagaaacaaattttcttaagtccaagctaaagtccagggtttatttgattccgttttttttttttttttggacagtcagccaatgctttactcactagtttcagtttctgtgaataagtgccagaagcatggagctgctgagctttatgaaaaggtatagacttttattaccatgaagccacactgcaagcaagtcttgcctgttctgtccctaaactactttcaggttaaccaacagttggaactcatttggcttattgtattattcaggattttcaaatgatttgccattatattgatggcttaatgccctattcaaaaatgtttcatagttttattataaggattttaatctgtattctgctctcatgttagtctagcaatcagcagtcattaatatgatgcgactctattgtagttaaactgttgtcagagaaaaggttattttctagaaattatgttggctgtgcccttcctaacagttcttcacatctctaatatttgaaaagccagtgatatttattatgctattttccttctagtcacttagattacactttcctcacactaccaggaatctcctaattggcaaatccagaagaggctctccagtcctttccttacttcactggctgtagctttttgtactgccagttcctccttcactaagtcattcaaaaatacatattgagtcctacgcttgtcccagatgccatgctagtcactggcaagacaaggtgagcaagagaaccacggtcatcacccacacagagtctattgtccagtggcagattccaagaaaacctgcaattacagcccacaaaactctcttccctttcatgtcacaattgtgttcaatccagattttatctaccttatcagacgtctctatcacagtatcatttgctggctgcttgcccttgtgttaaggatgactgttgctcaggcatccctcctaggctctctttttaccccacctgttctctacagataatttcagctcctcttcagatttcaaccacactccatatgcctgtgatgccagttctctggatctgcaagcccatcagccaccagcttgctagacatctcccctttagtgtccctttggcatcttaaatgaagcatgttcaaaattgaactcattaactttaatatgtactctttatactgtttcccccctccagtaatacttgatttcttggttaattgcattactatctatctagaatattttcactactgaattctgtgaggatagagaacttttctgatcaggcctatatctctaggttttaagaaatttaggaattcaaaatatttgttaagtaaattaagaggttttcttgactcttcttcctcaccgctagcatgagttgttcaagtgatcccctagtcctgcaaattataccaccaaattctctcaccaaatccatcccttttttattatcattctgcctaattcaagccctttcttttatacttttaacatactgtttcttctctgtatcactgtttctatctctgtccctctcagtagcaccctgtactttatatgaaaattaagttttacttcataagtaaattcagtatagatgcaagtgcttgaaataggcagagtttttcatgttcttccaccccaagtcactggttcttgccactgaacactaaactaaacatgaaacattgccttatctcaaagcaggtctttttctcctcacctccttcattcacgtataaactagaattctatttccaagaaataagtcaaaaaaaaaaaaccctaacacctggctaaggtggaggaataggactaggtgggagaggtggcagtgaggttgtttgcttggagatgaaaccaggaaatgctctaacactgctgtgttactacagccccaaatccacatgtgaaaatggcctccaaaatacggctcaatattaggctgctctctttttatcatttatgtacatcctctttcaaagcatgagtaggacacagctttttctctgagcctcactctaaaaatcactgaggttttaacattgtcagaaatttcataatttattggaacatgatattcattttccccttcatcatttcattctgtcccacataagtaaatgtcatcttcatgcccatcaagttccctctactactgattagtaagtttctgttacaatagaatatattgattgtcttccctagttgtgcgtatctccagctttacacagtgtttatggcagggagccccattacctgtgtgctccagaactgtaatgcttcaagtaattccttcatcaggatacagaaaggagatggaaccatctttgggggaaattactaagtgctttttgcaacatatgtcaagactttggatattcgtgatttaaaaactgatctctgatagtttgttttttcctaatgaaggcaggtcggcctgaactatatcacatccagttactacagcctgtcagaggcaaagggctctggttccagtgttttctctatttagtccgtttttcatagtctctagagcaccccttcagatcctcatctgagaggcggtacaaagtcgtggtaaagagtgcatgctctgaagtcacactgacttggctctatcaaagactaactttgtcacttctgtctcacccctttgtgcctcaatttcctcattttataatgggtagatgatatggtttggctccgtgtccccacccaaatctcatcttgaattgtaatccccataatccccagtgtctagggcaggacctggtgggaggtgatgggatcgtggggatggtttcctccatgctgttctgatgatagtgggtgagttctcatgagatctcatggttttgtaaggggctctttcccctttgcttatgcactttctcaagcctgctgccatgtaatacatgcctttgcctctctctcaccttccaccatgattataaatttcctgaggcctccctcaccatgtagaactatgagtcaattaaacctctttcctttataaattatccagtctgaggtatatctttatagcagtgtgtgaacagactaatacaggaaataaaagcacctacctcataaatagttgcaaagattaaatatatgttattcaatctttcttagaaaagtagcttgtgtgaatttgatcctgtcattatgatgctagctggttattttgcccgttagttgatgcagtttcttcatactgtcaatggtctttacaatttggtatgtttttgcggtggttggtactggtttttcctttccatttttagtgcttccacataacaatattaaccttaagtgtaaacgggccaaatgcccccaattaaaagacacagactggcaagatggataaagagtcaagacccattggtatgctgtattcaggagacccatctcatgtgcaaagacacacataggctcaaaataaagggatggaggaagatttaccaagttggaaagcaaaaaaagcaagggttgcaatcctagcctctgataaaacatactttaaaccagcaaagatcaaaaaagacaaagaagggcattatatgatggtaaagggatcaatgcaacaagaagagctaactatcctaaatatatgtgcactgaatacaggagcacccagattcataaagcaaattcttagagacctacaaagagacttagactcccacacaataatagtgggacactttaacaccccactgtcaatgttagagcaacaagacagaaaattaacaaggatattcaggacttgaactcagctctggaccaagcggagataatagacatctacagaactctccaccccaaatcaacagaatatacaatctactcagcaccacatcacacttattctaaagttgaccacataattggaagtaaaacactcctcagcaaatgcaaaaaatggaaatcataacaaacagtctcttagaccacagtgcaatcaaataagaactcaggattaagaaactcactcaaaaccgcacaactacatagaaattgagcaacctgctctggaatgactactgggtaaataacaaaatgaaggcagaaataaataagttctttgaaaccaatgagaacaagaacacaacacaccagaatctctgggacacagctaaagcagtgtctagagggaaatttatagcactaaatgcccacaggagaaagcaggaaagatctaaaatcaacaccctaacatcacaagtaaaagaactggagaagcaagagcaaacaaattcaaaagctagaagaaggtaagaaataactaagatcagagcagaactgaaggagatagagagacgaaaaacccttcaaaaaaatcagtgaatccaggagctggttttttgaaaagattaacaaaatagataggccactagccagactaataaagaagaaaggagagaagaatcaaacagacacaataaaaaatgataaaggaaatatcaccactgatcgcacagaaatacaaactaccatcagagaatactataaacacctctatgcaaataaactagaaaatctagaagaaatggataaattcctggacacatacacccttccaagactaaaccagaaagaagtcgaatccctgaatagaccaataacaagttctgaaatcgaggcagtaactaatagcctaccaaccaaaaaaagcccaggaccagatgggttcacagccgaattctaccagaggtacaaaaaggagctggtaccattccttctgtaactattccaaacaacagaaaaagggggactcctccctaactcattttatgaggccagcattatcctgataccaaaacttggcagagacacaacaagaaaagaaaatttcagtctaatatccctgatgaacatcaatgcgaaaatcctccataaaatactggcaaaccgaatccagcagcacatcaaaaagcttattcaccacgatcaagtcagctttatccctgggctgcaagtctggttcaacatacgctaatcaataaaatccatcacataaacagaaccaatgacaaaaaccacatgattatctcaatagatgcaaaaaagacctttgacaaaattcaacatcccttcatgcttaaagctctcaataaactaggtattgatggaacatatctcaaaataataagagatatttatgacagacccacagccaataacatactgaatgggcaaaagctggaagcattccctttgaaaactggcacaagacaaggatgccttctctcatcactcctattcaacatagtattggaagttctggccagggcaatcaggcaagagaaagaaataaagggtattcaattcggaagagaggaagtcatattgtctgcgtttgcagatgacatgattgtatatttagaaaaccccattgtctcagcccaaaatcactttaagctgataagcaacttcagcaaagtctcaagatacaaaataaatgtacaaaactcacaagcattccatacaccaataatagacaaacagagaaccaaatcatgagtgaattcccattcacaattgctacaaagagaatgaaatacctaggcatacaacttacaaaggacgtgaaggacctcttcaaggagaacgacaaaccactgctcaaggaaataagagaggacacaaacaaatggaaaaacattccatgctcatggataggaagaatcaatattgtgaatatggccatactgcccaaagtaatttgtagattcaatgccatccccatcaagttgccattgactttcttcacagaattagaaaaagctgctttaaatttcatatggaaccaaaaaagatcccatatagccaagacaatcctagtcaaaaagaacaaagctggaggcatcacactacctgacttcaaactatactacaaggctacagtaaccaaaacagcatgatactggtaccaaaacagatatgtagaccaatggaacagaacagaggcctcagaaataatgccacacctctacaaccatctgatgtttgacaaacctgacaaaaacaagcaatggggaaaggattccctatttaataaatgttgttgagaaaactggctagccatgtgcagaaaactgaaactgaaccccttccttacaccttatacagaaattaactcaagatggattaaagacttaaacataagacctaaaaccatagaaaccctagaagaaaacctaggcaataccattcaggacataggcatgggcaaggacttcatgactaaaacaccaaaagcaatggcaacaaaaaccaaaactggaaaatgggatctaattaaactaaagagtttctgcacagcaaaggaaactatcatcagagtgaacaggcaacctacaaaaatgggagaaaatttttgcaatctatccatctgacaaaggatccagaatctacaaggaacttaaagaaacttacaagaaaaaaaaaccccatcaaaaagtgggcgaaggatatgaacagacacttctcaaaagaagacatttatcctgccaacaaacatatgaaaaaaagctcatcatctatggtgattagagaaatgcaaatcaaaaccacaatgagataccatctcacaccggttagaatggcagtcattaaaaagtcagatgctggagaggatgtggaaaataggagcgcttgtacactgttggtgggtgtgtaaattagttcagccattgtggaagacagtgtggtgattcctcaaggatctagaatcagcaatctcattactgggtatattcccaaaggagtttaaatcattctactataaagatacatgctcacatatgtttattgcagcactgttcacaatagcaaagacttggaaccaacacaaatgcccatcaatgataaactgtataaagaaaatgtggcacatatacaccatggaatactatgcagtcataaaaaaggatgagttcatgtcctttgcagggacatggatgaagctggaaaccatcattctcaacacaggaactaacacaggaactgaaacatcattctcaacatcaaactaacacaggaactgaaaaccaaacatcgcatgttctcactcatgagtgggagttgaacaatgagaacacaaggatgcagagaggggaacatctcacaccagggcctgtcgggggttgggggactaggggagagataacattaggagaaatacctaaagtagatgacgggttgatgggtacagcaaaccacatgacacgtatatacctatgaacaaacctgcacgttcttctgcacatgcatcccagaacttaatgtataataataaaaaaggacctagcgtatatagactttctatatttagacattattaacttggtacactcatgcttaaagttgccctgatctgccacccccacccccaacatggcatctcgttacctaaaatatgcttaaagttacaaatcctttgcctacaaatggcacacagaccctttgagatctgtccacactgtgcctctccatttgtatctctcaacttttcctgttaatcgtcagtgtgttttaaccatgtcaagctgcatgccagactctctctggacttcccaaacattaataaatactagtcctttgtgacccagctttctggccaaatgctgtcttctcctggaagattcctggctctagcagttagtcaacttcatatagttattcaagctgtgcaagcttgtatagcctatgtatcgttgcattgtgaccttttttttcccttagggtctttcccacttgaactattccacctgttaagctcagtgcctagcgcaatggtgcactgctgaatgaatgaatgctgtaaatagaaattagtattatatatgtagacatgggattttagcttttattaattaagcttttggtcatttagtgtcatacatcttgaagtttttgcaagggtgaactcacatgaaatatacacatatgataaaaactacctccttggagagctgtttcctggggaatctatagatggtcatgctagctatgactgttctctagtatatttttggaaatggatcaaacaatatactatcccatttttttttcaaatctgtttccctctgaatttctcttgggttgctggacactggcaccctctgtcacagctttcttgctcccacagttaggcaagcaggaaggagtggtacccagtggcttcccttcttcgctcccatagcttggcgggagggagtggcagccagtggcatcttctctcccattgttcagcaagcaagagggagggttacatcttttttactccagctgcctgcagctcggtgagctggagggagtggcacccagcagctttttcactcccatagtttggcgtatgggaaacaatgttacagcccttttactctcacctcctgcagctggtgagcaggggtgttagagctctttttgctcccacagttcagcaaattccgggttcttgtcccatgactaagaggaatgaagtcacggacaccggagagcgagtaaggcagaatagaattttattgagcaaaagaaaagctctcgacagtgagtgggcacctgaaaatgggtagccatctgtgaagctgagtccggggttttttatgcatttggaatgaggaagcgcaggctgtaggtaatcttagaaaaggcaacattcgattaaaaaatgataaaaaagcattattcagaaagaaccaattgaaaaagagtgggtaacaggaatagaagttctcactctagttcatggactctatctggaattggtagtttggttttcagacttcagaggatccttggcttgtaggtcaagtttcaccagggacccatccctgtctgcctagaaatctgtctcctgacacctccattcaagtgtcatacatcaaaaagctacatattatcaaaatgtgtttccccacagacagattcctttgcaaaactggatgggagtgaacatcatggctggccgtcttgtgctgtgtgacagaacattaacatgcccaaagccagaggtctagaagacagtgtccctgccacagagggagcctccaacgtctgaaagtccgacagcattgactttaactcattgctttataaaaactgtaaacaactaaacccatgaggcaagagccaaagtattacagctcagtcaggccacaccccctgcaaactgtttctggataaaacagtcataacattggcttgtgtgctgggatttcacagtttaaaatatgcatgattagtgcctatgattgatgtgttaactaatgaagcctataccagtttagcagataatgctggcaggacgtaaggtgtctcagacaatttcccatgtggtgttgcatcagtctaaatccctttgaggtcacaggcaggatattggtcgattttaatgttgacgattatccaaaagaatgaccacatcatgaacacattacataatgtggtgggggtttcagtcttcatatggacaaaagaattctaacatcctaatggatgtaccaaacttctggctgggatagatatgaaatttagagaagagatgagagctgccttgtcaacagattggctccacatgccacatgttggcataggtaagagatgacatatgaacaaaagcagttgtcgaatactgacacaagggagctttcctggactcagtgagcatgaaatagactagccttaagcagtggtcacaatgaaatcatggctaaagaatgtttccgtggggctgtctctgaaggcagtaccccagagctccttcttgctcagcacccaagacaagtggaccacagagaactgcagcagtccaaatggagccgagggcagatccattaacaaaggccccaactcacatggaatggaatgaatgcttcaagaaacaccaagcctgaagccgggcacgggggctcacgcctgtaatcccagcactttgggagaccgaggtgggcggatcacctgaggtctggagttcgataccagcctgaccaacatggagaaaccttgtctctactaaaaatacaaaattagccaggcgtggtggcgcatgcctgtaatcccagctactcaggaggctgaggcaggagaatcacttgaacctgggagccagaggttgcggtgagccgaaatcacaccactgcactccagcctgggcaacaagagcaaaactccgtctcaaaaaaaaagaaaagaaaagaaaagaaaagaaacaccaagcctgatgcaaggcttggaagagcagactgcctgcagctgttaaggctgtgtggaaaggcactgtggaaaatggaaatcaaggaaataaagcagagattcttcatggcttgtcagttattttactctaaaggatatttcaattgcaatgaaaggtttaaatagacaggtagctacagtacaatgtttgcttctcactctggtacacagcatggtggtagttgtctacctgtttttgttgttgttttctaattcctcaggatttaattaatgttttacattcagtattatttagacaagctcaaattataatcattatatttacctccctaaattttattactatttcagtggcctagggggagttgtttgcagatctaaccttcataatagtctattaaatggctgccaagtttcaccacctcgatctagtctgtgcgagtagtgaaataagtatgcatttatcagcctgtgcaggacaaatctaagagtctcctaataaatttaaaagagcattactaaattcctctttaaaaaatgtaatgtcccattattagccctctccaaattcccaatgtcattagaaacctcaaggtgtctacatgctgatagcatttttaggggagagggccttggattcaagataaagagtcctaacttctgcagatgggcattatttcacaatcaccctttttttcagttttcctatctgtagaatttccctccataaatatcacatgaagaccaaaagccataagtgaagatttataaaatatttttatcataagagtgatatgccacatagcatttgagggaaaaaaaaatgcactgaatgaccagacctacaggaagataatcctttatctctacagattatttctactttaggaaaagaaaagggaaatttatggcagataggagttgagagcagcagaagtgttaggaggaagaccagtagagcagaccagccatgactgggttggagtttttatagggaagagagcaaagagattttaagcgggtaagacacataggtagataaaaacaactttttaggaaggttaattctgtattacatgatcaagcttatgtcaatttccactttgcagtctcttcaggagatttcagcaggctttctttttaaattttctttttcaaaaaaaaaaaaaaaagtaaaatattccttatctgcaatgcgagctgagcagcacagtgctccttggtatttataactcatttcccttcctgagctagcatatacttttaagccaaaaaaagatatacccttttccaagaccttctctgtcttatgccaccaaggaattccacttcagtagttgcaaaatcaagggattttcttttcctttatggttttggagactccccaagagctaaagcagaaaaaaatcaacactagatggccctagaagatgtactcttcatggttttgtctcttgtctgactgcccggagaagagttccttaggcatttacaaacacagcaatgccaccttttagccccactctttagggattttacatgactaattttaattgcataaaaggaactcatctttatcttggtgtgtgcagtgcaaaacacttaatgtagggtctgactctattctacagtaagtgcagtaagtgttagctactattacctcatcagcagacctgcaacaagagagtcctttgttactacagaattctcctgccctaatactgccaaagtctgcagttctagctgcatatatgcagttcctggtgcattggcggatctcaataatatttggtttgtggatatacaagtgaacaaagggctttgggtttttgtttttgtttttgtttttagcagaaactaattcatctggctaaataacctaagaatatgtaggaaaaaaattacaaccagaataaattcttgtttgctctttataaatggatcattggcaacctttgaggtaagatttgatgcatctcttcagtagaaattcagcaagatcaacctcctcattatgtggagcagcacactgagtaataagaaatctggcatggctacagtatcttgcacataggccatgctcaataaacatttattgaatgactgtcttgttaccaagactttgtagcaataagctttaggggttttagcctgaccatctgcttggctgggatgagtcgtgatgatagttcacattgggtttgtgtttaccagttcctaaaattcaagtgtgttcagatgtagatcctctgttagaaaatatagcagtatctgaaaatgtcttgcttttcaaataaaaggtgcagaggtgtgagtgtttttgcactgttggtttcagatggaaccacaagcatttggcagcatattgaagaagctgtcacaatcgagcttttcctcttggggaacctcaaccaaagctcagcggtcatttcccatggaaaactatgtgcctttggccagttgtgctaagataacttattggcctctctgatgtcagctaatttctgtccatcagtcctcagtgcctgagtgactttcctccaattcatatgaaagtatgcagaaggaaagttttacagctttacaacacagagcaggccttgcctttttatcccttggctgtgagcaccagtccttagccacatacattctcttgtattctgctccctttcctgtcccacattcttcatagatttttccacgttttctggaaaaaaaaatcaagaaaagcaatttcctaagataaatgctcccacctgcccttgttcttccagaaacacggatgggctggttggttcgttggtatttcccggtttgcttcccttttccctaagtgcgtcactgactctttgctcccgggagagaatgagcatgtggaagccagaggaggcctgttcacgcccctctcccctcctagcacctcccggcctccttccttgtatgtgtttccctttaatctctcaatcttacatctttcatatttgcaagagtgtacagaactatttgaggagagagaactggagatctagaacttttttttaacagattttatttgtcatagttccttaataaagaggaatgagcatctcatagatgagtgcatatggatgagcatgatacagcccagagcccacctgagctcatgagaaaatccccccagtgaaaagcacgccggggtgagggtggagcggagcgtggaaagcaaaccaattggaaaggtgttccctgtattaccaagagcccaggagtcagtgtttagatgttcacttcttgcaccggctaacatgacatagctactttgtgtcctcaagcaagtctcttaactctcagaaccttagttttgtcatttgtaaagtttgggtagtaaaggctgctctcaccacctcacatagtagctgcaagagtcaagtgagtttttttttttcaagtgagatttttaaaaagctttgtcaattgttaggtgctttaaaaaagtcaacagagagtgttataactgaaagagatactttaaaattgctatagctacctgctattaactaaaggcattaagaaacttgaaaaccaacaccaagaaaaagagtataattaaattccccgacaaatagtaatttcatcttattcaaatagtcttcttctgaagtgatctcagaaaatatggagctatttacaggattaatatgtcctaacttcccttttatgaggtaaataaagggggaaaaagctaaggtcatagaaaatttgagggttattggttgccagaattggcaaaattaatttatatttctgctttgaaacctgtttagtttctgtagaaaggggaacttttcaaattaaaactgtagtctgggtcagaaagctatcaaatagccaaggtaaaatagggaggaatccaggattttcccaccattcactcgtgctgttgactcctgccttgtgggcctcatcttggtcaggagctgccactcaccttttctcacctgcagaggctccaccaacctaagtgggaagattggcttctgttaccaagaagcagagcataatgctaagggaaggatagaaaaccctttctgttgtgtttcttctatacttgctcatcatttgacattgtttttgcactcccttcattccttcaaatctcatagactttctggattctgagtctcagaccttgaactacaacgtatgcgtctgtctgtctcctgtggtatgtcattacttccagatgctagtatggaaagtggggaagaattaggcattggaattatgataagtctgagtccaagtctcgactcttccactctccttgcacaggcaaaggaaacattaggtattcaaaaatggccactattattatgtatgtcacttctaaacccacaactgatttatccattctctaaccctttacttttgctgtccttgcttgcttgcttcaaagccaccccttcttgatcctgcatctctgtctcaaccttttatctgatactcacacctgaatcccctgccccagctctgacaagatcatgaattagagtttcattgtagaaagatctatggtgaagagatgcaatgaagtatcaaggtaattcccttctaaatggaaaatgaccatcacaagtatttttatgtcccagtatttcattttagtgagatttttaaaaattccttcaggacatgtaagaggagaaaaaaaaagaaattcaaatagcaaactaagaatgtatggtgttcatttgtaataagcaggaaagttaaatatatttttaaggagataaaggagctaaatcataacatagctgccattcattgaatgcctactgtatgcaatacaatataccaggtgctttaaataagttattgagtttactcgttgcaaaaaccctatcagtaattagcactattattattctcttttataggtgaagaaatttgggcctagaaagattagtctagttacctaaagtcacgtgatctgtatgtggtagagccaagattcaaacttgattttacttttcacggcatagcgtgctcaatgtagaaccagcctgcaagagtttcctcaaaggctgtgtcacaccagggccacatataagctcctgggctattctatcataaatcagaagatacaggctaagttataagaataagttattattatagtaagagtgtatgctatgttaaacagaccattaaaatgataaaattaaataataatcactgacatttattgaacacttgccctacgccaggcagtactctaaatgctttgtaagtatcaatttagtttatccttacaacaatccagtgaagtacatattataattattgccattttacagatgaggaaattgagcacagagagttaagaaacatgcccaagtaagcggcagttaagaattaattctaggcaataatgtaccagagcccacatgtttaccctctatccaatacaaactgcctagttaatttaatcctgtgttctaattcttttgaattctaatataaagcacattatcttgtaaagctttagtttaaaggtctgccacataagcaacagggcctgctcttcaccatatgtgttcataatctggataattccctgatggggatcatttggagcaaacatttcttatggaatgattttctatgactgtgctatgctcaactgccggagcacttcactgctatacctcaatggaatgccagcgaccgactgtctttctatctacagttaatttggtggctaccgctatgctctcaggagccagttgtctatcatatccctgcataccccacacctttagtccactccaagaacttgctccccacagtaggcctgtgagtctgaggttatatactcttattctactggcatcccattagaaactactttctgcggctccaatattccttctttattttgtcacttgggatttcaatcagatattttaaagcttcctgtcctttgagccatattattttagattctctaatggtgggattatacctgtaattttttctgaactttttgaaacccacttccctaagtttagtatatatgtctgaatccataaggctcaacaactcttcttttctgacccaatcgcctacttctcccttgcctctcagactcttccaccttgtttgcaaagtttgtttgcctgtctctaggcaaacctctatattttattggaatgttccctttaccattttgctctggtaaggtaatatgatcagtttctacttgttttgaatagaatgagattgccaacagacaggcagctgttgtcggatttggaatctgtattagcaaagcatcttccttgtttgttctccaatgggatgtctacgtgtagaaccacagtgatgtcacctcacaccttcccctactaccttccaccatgtgttaatcttcaagataatgaattctcctctgctgtgtattttcttgccttagtgtgatagggaccaatatttatcttaaaaggattgatgtaaatcttccacccaaagggtttagtttgctttgttgcagtagtttttacaactaagatgacatattcatgttctggattcaaaaaccttttaatcttgctaatacttggaacatgtattagtacttagcagtgtccaccaactgctttttagttcaccttccacttctcaagggagtgctcagtaaatagtacatgctcaattaataatagttgacattattattattattagagaaaagacatataaagttgcagttttccaagagacaatatgacttagcaggcaaacagaggatattggcgtcttctctgccatcccttttgacaccttacagaaccttggtgagattaattaattactcatcttccactgtccctgaatgcaaaataagggtgaccttatttcagaggaaaggtgacctcttcctctgaaagcttcatgacttaacaaaaagtaagatacattgaatcatttgaatgccaactgtgaagaataaaatattgagtaatgcttactcagttctttaaactattgacctagccatggagttagcaccaagatcataatttctgcccttttttgaagataaaaatcaccatcagaattgccagccaaggtaggaaaattgaagaggaaggttacagtcctgaagagcaagcactcatatgggagaattgggaaaggcaataatatagcggcctcagaagcctggtgaggaacaaaagtataaatgcccaataaccttatctataccacaacatataaaattgggccttggcccagtcactcttagctaataaagaaatttatctttagaactgtgaatattatagtaggactgggatgtgctgcctgcattcccacttcgagactgagcctctcattttcacagctctgagcagagtccttctccagaaatcaccctctgctgagagaagctgcctctcacaatggccatgccccctcgctgaggacagcctccatccatggataggttcagagacttagcctcttgtctcaatgtgatacaactctaaagaaccacccactcaggcagaggctgccgcaccacaggtgaacttctccctctgccacattctgctctgtccccccacaccgatgttgttcctgtggctacttcccaatgaacctcctgcacacatgtctcagaatctcagaatctatttcctggggaatccaacgtataacgtatactacctttgcattctaaggagcaattacaactattttcaattttaagaacatcatcaatcatacaatgatcacagaattcccataactaagtgaatctccctcttgacctttgtgtgggctgcatttgccatgctatgtgatatgtagctagtttctcaagtgcaagtgacttgaatggcccccaaataggggaaatattctgaggtattgagactggccagttaccgtattatacttatgatcatttccaaaacaaaagaaaaagatggcaagtaatcaatactccttggccattctgttgaaggttggtttgtgactagggagactgtattagctcctgagggctaaattaccacaaacttggtggcttaaaaaaacagtctgggggctagaagtctggaatgaaggtgttggcagagttgattcctctgagaccctgagggagagtttttccgtgcacctcccctcgcttctggcgttgcctgcaaaccttggtgctccttggcttgtagatgcatcactgcagtctctgcctctgtcttcacatggtgaactcttcggtgactctcccgtgtggcatctccttgtatcaaaagtagggcaggcctaccctaatggagtatgacctctcacctaatcttaacaaattacattggcaaaggccctatttccaaaagaggtcacattctgaggttctggataaacatgaacttttagaagatgctattcaaccctctgcagagaacaactgaggaaacaaccaagatctgcttcccagttgatacctgtatttgtgctgtggatcttttaattaactgccttaaaagaaaacacagtgacccagatgtgtgcagtgggcgccacccaatgacagaaggctccttgaaggcttaatcaattagataattagtaggaccaacagggagttggtaaagcagcataagtaaaaccagggaaaggatcattacccagactctgaccattaatttttagtcatactgaaaaaaggagctttggggaaaagacagatttgaagagatattttattcactctcatatacttcattttctaaagcaacatgatgtggtagttgagttcacacagtaaaatattagataatttgaggaaaagacctaaaggaatgctacacaaatatatttagtttggccacataaggactccacgtatctcaggtcatgcacaggggtagcaagtcctgtcttgtgagttccataactttgattcctgcaggaagaccccagagacctgcaaaaagcatcctccgtctactaacatcctttctctcatttttccctcttacctgacttgattataaaattaggaaatttaaatttaggaaataatgaggagacagctagtaagcaaagaggcttcccaagccacacacacacacacacacacacacacacacacacacacacacacacacacacacacacaccagaacacccttaggaggcatttctaagcatatccatccataaaatatttttctgtttgctgtataagcagaaaggtttgcatagaatatgtcctttgtaatggcttttgcctctgagctttctaacactagcattgatcaattatcatcttctccacaatagactaatgtttgaacttggaactcagttctagaccagacactagaatactcgtgccatactttcggaccaagccagagagaatgacttcacccaggagagaaagataagaaaagatcttgatgtgtaagcctcctttatttacttgccatcaatcaccaaaacaaagtggaaggaagggaaagggaactattaacattgacccatataaaattgctgatattcaattggttttgacttttaaaaattgcatttgcaagtgattctacctaatataaaattgtatttaaacaactactttttgccagtcactatgctaagtgccttattcttatattattctttataatcctcaatgtaaactttcaagattggcattataatctctattttctgtatggaaaagctgtggcacacaaaagttcaataatttattcaaaatcccataatatttgaacccacacccacttcatgtccagtaaagtcatttgggtctgctgaagtatttctagactttatagtaagattattttcaaactctattgtcaaaattcttgaaattgcaaaggctactccgtctacaaacttcaagggacgtaagaggatggttacagactgtcaagaggatgtctgtggtacatgggattggtaatgtagaaattaggcagtgctttgaatgttactgacaggtcacagcacactgacagcaacagggaagaagatattgtggaaaataagacaacctcttgagaaggtcatctcagtatttgtatcactgatggggtttacagaaaagcagtcactttatccactggcagctgcataagttttaggttgcatttatgtaaagaaacaaataagtaacaagcaagctggcattggtggtttctgggactgaggaagaggagggaaaagaaacccctagggctatagctgtaacatacttactcattcgcacatttgcagctctatgtgtctttagcattctgtgaaagctgatgttcataatgttgatcatggaacatcgagacaatactaaattatgtttaatatagacttgttgagaagcagagaaaaggatattcgttttaagcaatttcgcagtattttttttaataccctaaaacggcaaagttttagctcttgtagagttaatgttcacctttctgggaaaactctgtaatccagaatgacttattctctgagaaatccaggtagtttcatacatgcttttgtaccaagtcatattaaactctttcattcatagttttgtccatgcttttgtacttataataggttgcaactggtataataattacagtagaaagtcatttattatgtggatctattaacatctgattcctcattaagcattaagaatattgccaaatctgcacttttattctttctgctgacagttagttttcacagtgcttcttgatttacttttatgattgaagtttcaggaataaatgttttaatttaatgttccctcagtataacagatttgactaatagtttaataaagggacaccgcaagtttctaatagagagaggtttgcttgtgttcacgagggatgatgcgcacatcttgatgaaggctgcccatgacccactgtgtgctgcacgtgtccgtttccatccgagcatctcagcacagcatttgaagcaggtagtgagaatcccagtcatggccaggaaggatgtgaagggctaacgggggacctggatattttggagggcctcagtcttcctctcttgcctcttctcatccctctttacagaatatttcctaggctgtatccccaatgaacttctatcgatttccaatacaacccatatgtctttgcacctctgtgtgcatgcccttacttctgccagaaatcctccttcatcattctcctggtgaactcctagtcatcttctgcaaggtaaagtccttctccagaacttcacataccctctcctgcctgcctccctccgttactacccccaggactctatgcataactcttccagtgcattcagctccaaattagtcagagttgcatttagcttaaaaggatgcttcaccagagtgggtactgtgcctatgtagcactctgccaccaataattagcacatttaccttttaaaaagaattgatctatcagctgtattcttatggtggccttctacattaatgaatgacataatgtgttttagaatggactagcctgggaagtaataccaagatcttgatttttctaactttcccaatggtttacatctatctattctagattgagattttgtttataactttgagatttaccttgtgcacaatttggaaaagggaaaacaaacatccatttattcataaaatatttcttaaatgcctcagtcttaggtgccagggaaagtctgttctcggcagcatataatgcttacagtcaggtcagattccttgataacagcagggaacaaaaatgggaagaacaggcaggctttccggggcagtgttgatgtggtaagtatgggaagtttggcattgggattagatttttcctaccctgaaaaccatcaataaaaatctctcctcaaggctgaatttcttaattaattcatttcaagccattaacagagattttaaaaatatggtctatgtcctcagatatctttcttttgagttgagcatattcttcatacggaacaaagagcaattccaaagcaaagtgaaaactggacagaatggtgtaataacaatcactgacttactgagtacttactgtgtgctatacttcatgtatatatattactcctttaatcattataataacactgtgagtaaggtatttttagctctactttacagatgaagaacttgaggcacagggaggttaagtgctttaaccaaactcatgcttggatgagagcatggccttgaacccaggcagttgggtgctaaaggttgttctcataaccaccacgttacacttcctctcaatgcttaaaaaggaaaaattatttactcagaagtattgaaagagagtagagcaaagaggtcctggagtggcctagcatgacctggcatggcttcttgcaggtagagagatttaagccaatatagcaggaatggtagatgttggcaagaagtctacgtgaatggaggggcctgaaaaaaaaagcctaagtctgggcatgagcaagatgggaagtgactgatttggcaggcacagttgtctctcacacttaacagtacctttcaaggccagaaaggatgttcttaattttgaaactcatacatcaagtatagtggttaggttgctttttgcactgagctgtggagaaaagtacaggttgttacaaacctaattaagataattatttaatagaaatctattttaaagttttgaaaaatgctaacaggaatcaacttttaaggataatctattcagagtcacctcctattaacagtcatgttattaaccaactcagggcaaagcatgattatataatagctcaagaagaggtagtgttgtctcattttactttctgggacctaaacacctagggaaaaataggtgataaaactgaagctgtcacaatccagcctctttactcccaaagtcagtgccacacaattaaaataactacaaaactcagttaatctagatagtatactataaagataatccttaaatatgggtacatatgagtgtgtgtgtttgtgtacatgtgtgtgtttagttagaaactttgaacacagattgaacttgaaggcatttcagcaaggagagatatttggtaggatatgaaaatgaagtttacggttggaataccttcagaacctcaagtgcagcatcctgattctgtgaagattatgttttattcctttacctattcccacgtgtaatactttattctctttgaattggcttctaatgcaatttaaccctgtttttgagtgtccactagcttaatttcttttattaatatgaattcttctccttcctactgaataaacccagctaatgtgtttttttctcctttatcatttcatgcaaagcaaaaagtaaataaggaaagaatatgattttcgcttccatttttttccccaagcctaaacaatggaatcggagaatctgtttttgaaatctggaatcttagtatttgctgatcctatggaatcaggacacttgattagctgcgagccaagtcatcaggcccacttaatacaatactcagtaaattaattcaattttactgatgtgactaaaaactaaatttcatatcaatataaacacttattaagctgcaaataccacatcatgcaagctgttgaaaaagactcatttttatttatagatgaattctgataagaatagcattagaagtattttagtagggaaatgttagagtgattaatgtgtagttgtttgcatttttaatatttcactcatatatcagattaggatttgtgcatactgtcagaatttattctgttcttgtcaaaatacttattactgctgacaggtataacatatccacattaatccttaattccttgattcaattttctaattgcttttttggcatgcgatggtggccatttagtcttatgtgatgtattcatcatatggtataaaaatgttctttaaaaattagatgtgccatttaaagtaactgagcaggaagaaaaaaatactaaggattggaaattttaaatttcaccatacttagacaaactattagatactggtatgtcacagattctggaggttgtccataaatcatagtcacagaatgttaaagaggaaagggaccttaaaaatcatccaacctacctgttcattttccagttggggaaactgacttagtaacaagcccaggatcacacagctagctagtgggagagctggtctgagtacttatatgttctgatcactagtcagaaatggggtaggtatttgcatataattgttataactggtattctaaattgatttttactattaataggctgacagaatgagagactccttagcttcttaagctgtatgttttagtaatattgtatagtggctgaaaacctagattctagaatcagagttccagtcctggatctgcccctcactagctgtcttaccctgagaatacagtctgaccgctctgaatttcaattacttcatctgtaggaaatggaaaataacagtatcctgctaataggactgctgtttaggttacatacaataatgcatgtaaaaagcttagcatagcacttggcatctagtaagtactcagtaaatgttacatattattattattagtgttttactatccctttaatatccacaatttggagagaaacttggtcatgccttgtcgcttatttcaccatgtgacctctgtgacaacttcatttattcattcattaactctttcacttaccatgtgcaatgcactctagtagttgctataggtaagacaagaatctaacatgatatctgccttgcagaagcagggctatacaacatgtacatcaataagtataataaaacattgggagacataggtcccaaaaaggtggcacaagcaccgtgcttggacatttcaaagagaggaagtgagcataggggatatagggatgaataagaaaccggacctgttctcaaggagcttgatccagtgggaaatagacatttacccagctgttattcaaagtagaaaataaagagggtcacaaaagttaaagttaaagaactaaagagggagaaactaaatatctcagatcagagaaggctttatagatgaagtgacatttgagttggctttgagggacgcataagatcaggaacgttggagacctgtgggaaggatgccttagacagtaggaagattaagagtgaagaaggcacagatgattctgaaaaccctgggaacagttgttgaacagttattaatagcacttaatttgactaaaaaatagagcttgtgcagaataaaggatgtgattagatgagtatgtagggaatgtcattttggactcaagcctcttttgacccaagacatggtcagcacacgttttaagagttaatgtctttaaagaactttctagttagtacccactactttttattgtcttactctagaggataagtcagtcttcctacctattacaggcaatatagcataaagttaagcatacaagctcagaaaatggactgcattggtccaaattcctggttatgccacctattaggtctacaactttatttatgtcacttgaactcttagaccttcagtttcatcatctgtaaaatggaaacagtcagtgtctcatcgggtaggtattgacatcaggcatatagtaagtgcttaataaatgttagctattattactgtgttacccacctgtgccttgaagcgacttagtttacaagttctgctttggaactactgaaaaggtttttgagaaaggatgtaacatctttttaatcttgagtccttgaatgttctactaaaccccacttaaattgtagtgactcgtccaaggacatcagataattctgttaagccctcacctgctggaatatggtttctagtgatgggtctcagtgtgatttacagaagtgaatccctcactcgccattggagagggccagtggaagaacaagtagccagctttacccattgatgttttccaaacgtgcagtgattcatgtagcaggagtttcccaggattgatcctgagctcaaatgaacacctcattttcagaacaaattattaggagttttaagaactataccttgaaaatcttcatgattctagaagcttctctggtaacatttttttctgtttgtaatagctgaaaaatagaaagcatttaatatagaatttttgcccctaaaacagcaacttgaaaataagagtacaacagttttaaaaacactagactgaacaaaagcagtctttttaaaagtgctgtgggcctaatacacagggactgctaattacgtaactgtcagtgatgttttctggcagagcctaacaccagcttcttgcagtacaacgaatatgaaaatgcctagaagtaaatcacagttgctgagtgctgtgggcaaacaaacccaggccttatctctttgaaaggcagcaatggaaaatacatgataaattgcacagctcagtgaacatgttatgtcattgtgaaatgattttgattcatggttatgtagttatcacgaaacaactgccaaaccccagggtatcagaaacattatcatttgtggggttttgctattttctgttgtaaaattcaagtgctataaagagatgtttgggtttttttgtatataaaattctgtattgaaagtgatatttgccacatactctttggaaataatattttaaattatgtgaatttcttccagaagtatcaaagagctgtgctagtaactaatattttaaacagaatgaataattcatatttttgctaatatccttttatgaaaattattttacctaaaatagactaagttgtaagtcaatttgattttttaaaatagaagtataatctccttttatatagcttatcaatatacagaaatttctgaatgttttctatacaatagcagtagaactaagaatgaaagagtaattttttaaaggaagattttatagaagtagcttttatgcaggcataatttcctttccacgtttgagatattctactccactgtccttatttgttgctaagtctctgaagtttaaagtgttaattagaccatattccacctgaagtttagttattttttgttaatttttttctccgttgatgctgttgatgatttgatgttttgaaatattttctgcttgtgttaaaagtggcagaaagatagcctggcaaaaagatcaaattgatgtactactgaatcatttgtcgtttttctcaatctcctaaaccaagacccactgtttctcaacttttttgtataaacatacaattctactgttctaatttttgcagtcgagttttttttttaacatgcctttggatatgctgaatagtatcagttaatacactgagagtttaaaaagaaaaaacaaagaaaagcttgcccgttggtagaaatgattgattgtttcttaggtatggtttttccaatatatcactatcgtttaaaccttgagtttattttatgttctgttagtatattttaatcaattgacctttacatattgtttgcatttattaaattaaaataacttttagtagcctgtaaatatgatttgaaacatttcatagtatttttcttttagctttggaataagacaaacctattctctaaatatttacatcactggagaatatctatgtacttatgctgatttttacttaacattttcaaaaataagtctgttaaattaaatgtaagctttaaagtgtaaaaccatagatcatgtaacttgatacaagtattgcaacatggcttacagcattttcttggaacatttttatgccctttgcttccaccaccatcgccactttcacctttatattgaatgctcccaaaatgtatctatatgaggataattttaaaacatgagatttatgttgctataaaggagaaatcctttataaccacataaaaccattgtcaccagaaatttcagtccaagttttacaagaaagcaggcatattttatctttaatgcctcattaaactttctagaaacgacagtattctagaatattctaggtgaatgactgcatatgtctgtatttcttcttaaaagtttaaatatcatcagtgaaaaaaacctgaacaaatcatttgttctaataattaaagccgtggtacttattcttctatttaattttgcctttcctcagaaatgttgctttgatatatcaaccatgtctcttctatagctctttaaatgatggccaaaactaacattcctaggctaaactgatagcctcactattccaaagatcacattgtgtttaattccaaatttcatatgtggatttgtgtacacgtgtgtacttgtgcatatgtttatgtgtacatgtgtggaggtgcatgtttgcatatgcacacatgtcataagcctgcattgtgtgattaagaatgtgaactcaggaggcagcctgcctgagcttaaatgctagcccaactactgctaactagctatatgaatctgagcaagctttgttaacctcttgcttcagtgttctcatgttacagagttgttgtgggtttaaataagtcaatatatgtcatgcactttgaacacctaacccatagtaacaacttaataaaatactagctattactattattattattatatatttatttactctatgttatttctaaagttatctatacaagtgcattgatgggtgattagtaagtaggtatttcactaaaacaatattaaagatatgccaacctgatctcacatttacatgtggattcttaaaaaaagtcaaagacatagaaacagagaatagaacaatattcaccagggacagggagggggaggatatgaggagatgtaggtcaaagggtacaaacttgcacttatgtaggatgaataagtctatagatctaatgtaagcaggaggactgtagttaatactgttgtattgtatactgaaaatgtgctaagagagtgtattttaggtgctctttccacgaaaaaataggtagctgtatcaggtgatgaatatgttacttcgattgactgtagtaattatttcactatgtatatgtatatgtatctgtgtatgtatatgtatatgtatatcaaaacatcatgttgtacaccctatagacagtaaaaataagaaaattaagatatgccaacagaatattttgaattgtgatcacttaattagataaactatgctatgttatacatcattggtgagaggaaacaattgggaaaaaggaacaaaagttgcataactttgtggctcacaagctgctcgtcaaatatagtgaaatttgttgatttattcaagtgtaggccaagtgcacatccatagtgtgcaaggagctagtgttaaaataacacatggtgtgtcctgaacaactaggaatgtacagcacagctacctaaaggatagataaggtgaaaattaaaatagcaatgctatgtcaattttgcaaacttaaagtgggttttctttttcagggggcacccaagccaattgccattgaaccatgtgctgggaacagagctgctgttctgactgtgtttctttgtctaccacgaggatcatcaggtgcccctccccctgggcagtcaggtatgataaatgaggagccttcagcagttaagcaaaacttgtagactgaacagaagaaataaacaataccactaaatagcgcagtaaggacctttgcaaggttctaatttagagcatggtaaaattttatgagaatacaaacttttacccaactatctagatacctgcattgttataaaggtagatttcccagtgtttctccgaaaaacacatgttgaatatgtgtttatttgtgtattatacacacatgtatgtatgttcccattaattgctggaattacaatgagaaatctcattagaagggccaccatgttctagacccttccagccagcttcctttcttccagtatgtgtggcatgttggaaaccaaattataaatatgattagaaatttgctttgtgaatgtggaaccaaactagggaacgtgtatgtttggaacgttgagtggcatcagaggatgatagcttcacgcaaccatctcagtaggtttaagatatgccattgctttcagcaccagctggagttcatggaccagggaaaccctctgtcttaggtgggcacagccagcctttgttctgattctccttttcctgtaggaaaagcatgtttttgatttcaggataattatacctgtcctcttagagctctgctcattgcgatggtgttgtccacattctaagcatgctcaatgttgaatataaatcatacttaaattacagaccacacttttttctctctttttgcatatactattccatctttataattttgaatttttctgtctcctgattattttatctatccaaccactactggaatgaatgctttttgagggcaagggtgatttcaaatctgtttttctcttcaattccccttaagcataaaataaaatgccagcaagctggcaagttctcaataacagtaattgatgatgaaccggcctccttgcttattttatcttttcttacttccctacttggctttgaatttgctcctcactttcttgacttgtgtccaaccagacacaaaaaatggaaaatgtactactttatgccttgtaaacgttaggtattcatgtaacagaatttttcccatatatgggagcagagagtttccatcaccttcagattcatcattcatggtacctgatgatatcttattgcagaaatttctatccaaagttcatttatggatgtttattcaaagaaataaacattttctgcaccttttcatacattgagtgaatgtcttgttcttttcctttcagcacctccaaggtaaatgggatgcaataagtaaaatagtttggcactggtcagataagatggataattataggtacttgcacagctaatggaagtattgttttaaaactgggatgatttccaaaacaaacacttcactaatgaaaacaagtctgtgtgatatacaccaaggtttttctcgatccttcacgagatgggcagactgaaggcaactgccaattctctgtccctttaacctttgaagtcctttttgactgatatgaaagagacaagtagcagtgtgaaccattacctcagctgtgttttctaacaactgcattatgattactaatgttaatgttatcttagatatgcatagtactttactctttctaaaatgttttttctgtttttcacatgtgatcctcatgacagggttgtgagataggtattataaaactaacatcataaatgaggggagtgagacgtagaaagcactgtatatctacactcaaggaataattggggagaggggatactagagtatagagcaaaagaataaaaaatacttactgctagcattccaggtaattgttcctgatgatttgtagcagaaagcctctctaaaatcaacagcccatgtctttacaaaagcaagcatttggatgaatactgaaaatgtctacagggttgatagagctagacaaaagattgaaatagcttaccatactttttacagagcctgaggatgaaactatgatgagtatctgcgtacataattcagaatgagcttgttctttgttttctaaaaacaatctagtagatttttcaagctcttagaggagtaagacagtggttctactctttaaattgcagcattatctgttatctgcatcaatttggaagatgggtaagaggggtagatggactgatatgtcataaagcaagtaaagtaaaatgttaatggtaggatctaggtgctaggaatactgatattcattataaaattcttttaactttgatatatgtttaaatatttaataatgaaatgttgggaaacaataaaacaaaatgtcttgatttcactgcaagaaaaaaggcagtatctgtagagaaaaatttttccaatatcatcatctaggttttcccagaacaaggcaaatactgacaccaatatatgaactaagtgactatttttttcagtgctcgtccaaatatttagtgtatgcacagccaattaaaacttcacatatttgagaggaaatatatcccagtgattatttgggaaccatattggctcttgggaaccaaatgctgacactggttatctcattgctgaagtttggtttattctgtgtcttcacagaaagtccttatatatgcctgtgcttatcccagtgccctacacatagaaatcagttaataaattattttgataatgatgatgacaatgataggagacttgggaaatgtgacctttagcaaccacttgaatctgttagcttcagctaatttcagtaaaatgagcaacagagttcaaattcatttaccctttcccagattcctctcctagaagccctctatgttctcttgagcctcctccactatttgtgcagggtgacaggttgggggagttgaggaggaggtagaggtggagctttgttggcagactcctgaccccaaccccactgtgtgaaggacagggtgccaggggtcttctcttggctattgggctatttatttctccaaatgttagtgtatctgttcagttattaaattagcgttcattattaagagtcttcttatagattaaaagtcttatagtactttgcataatctcaaatttttttgtcaggctccttgtttgaaatgtagcttactaaaattttttttttatcaggctccttgtttgaaatgtaacttactaaatgtcagtgtcatgtgtactctccgttggcatgaataagagcatttaagaaggatgagcttgaggatctgcaaaggcagaagcatcctatgagcatggtggatttctctcacacagtgaatttcaaccctgaaaatgagtgacagaaatgcacaggagctagtttggccatctcttttcaggagcagctagtgattttttttttttaatttaaaaaatagcattatctttggacttgattttctttccaccagcaactgcttcagcaatatgtggcaagtaatgcttagacatggccattttagtttctttctgaaatgtgtgaactcccttccttatggatcttgtcttaaccagaggtcaaaagaaaaactgtgccaactcatcccttagattacccatgcactaatctctttttaatataataaatttaggtgcttgggagaaattctccctttagggggcttagaatagtaaggcaaaagatattaagtaggctttttggcattcctagagctgggctaattaggtttcctgcttccccgcccagtaaacctgctgcttcatttctgtattttctgtgagcagccactgcaatccgtgccagactcttcggttaaggtgggatttatgctgttgtttatgcatatgttcactgtgcagccactttgtcttctgacctcaaagtggttgaaagattgacatctccatgaaaacaggacacattaagtaactctcctacatgacacttaacaaccaagcatgtctccagtcaccccggacagcatggtccccaagcgttttagaggcacattaagatgaaatgtggacaaagtaaatagagctcttcagatgcataaattgaaaatgataatgattgctgtcactttgtgatggaagattatggatttcataatttgtggattcttcctaatgagaagcagattaacttttctcactgaatcaaaaatcccaatggcccaaatatccactgctgaaaagaagctatgtgctacaactggaagtagaattttgccatgatcctgcctcatatatgattgactataccattaccaaaagaatactgccagaaagtctaaggttttgaaattctgaagttttctacgttagccttagaagtttgggcagaatgattagattattttgaataatctagaaatattacataatgtttaaaatgatagtttactcatggtgtcatggatgtctttcttgtttataatgataacaataagataactttggtttaatttaatgaaaagaggaaagggaaagaggaccaggcattatattaagcgctttatgtattcattggtgtgaccctcttaatgattctgtggagatgattatcccacttttactatttagaaaaccaaaactctagagagattaaatgactttcccagggtaaatgcagctagtgagtgagtgagccagaattcaaacccagggccactggctcctcagccagtgtgactctccctcatcactgtgtccctgtggataaagatactggggcatagcccttattcctaaaaaagctttaaatccagagtcaaggaggaaggacctagagggtctctgctgagcagtgggcttattgtagtaaggacaattttatctttgccggtgacttcagaaatttggtaaaatgcaaatctgtgcatgccgtggcgcatctgctcatgaaactatgactcggtgtatgtaataggaagaagcccgtgaactcataggaaaagaaattaaacttgtatgtctgagctctggacttggaatcacaagccctaagatctagacctagctctgccactgactagcaatgtgaccatgggcaagtctttcagtctctgggtcttctattttcccatgtgaaaaatgatggggtcgggttagattcctaggatgcgtttcactctaaccccactgcacagtttaatactacaaattatgctaagtcatgacagtttggggtggggagagcaaataacttgcttctgagtggtaccttgatttatcttttcagttgctcagagccattgggaaacttaattttcatatgtattattagtgactaaaaataattagcattgctccttacatttaaaaaaatcttaaaactgtgttaatgaaatcttcctagcatgtttgaaagatgtagatggtttatagtgcccctattttagaattgagtaaaaggaatctaatactaccagtgagaggtacatttcccataatctcagagatggattggaaatggactccgggtctgctggctcacagtgtagtactttctcctctgaacacagttttttaaagcaaatttccagtttctagcagcctctgaaatttctattccttcacactttgtttttcttttataattctgccaccatatcttcacacttgtagaaacacatctgttgatataatcttagcactttctttgttagaggtggctagaataagaaatagaactactgaattatatcaaaacttcattataaaaatctggcatgttagttaccctttaacctcaaatacaaatattgtttataggcagcgtatgtgtcttcacaaagaagaaagaaaaagtggcattcatggtaaaataaactagaaaattaggcagagagcccaggaaacaacagagataagaacaaatatctgagattcttgttaataaatatgactccgtgtcaaaaaatatctgatattaaaagactttaaaatcaacagaagaaactattttaccttgtatccaaaatacagttattgtgaatccccacttgctacccttactcattcaagaaacgtgtaaaagtgtctattatatgacagcactggatatactatagtgaaccaaacagtgttcctgccctcatagaggttacagcctatgcagagataaacattcaacaaataatcatgcaaataaactcatacttacaagttgtgttaaagtgctatgaacaaagaatagagagatgaaataaaacagatggacaattgctaagtttaatatttgtctacagcagtaatcgagtgataaacatagtcattaaaatgccctttcctcaattctcgcatctctgtagtgtttgactgtcgattattcccccacttcacctccccaccttctggaaaccttcccctcctctgttgttttgtgccttgacccatcacaggtacccacttagaattcacttagtggcgatggctatagagcacctcctttctgtgcatcctcagcttcatctgccccttgcctacaggcattcccccaggtctgatccttagccagcttcttttacctctccactcacttagggaaaacttctctgcagctaactgccgatcctgtgggtcttcagccaacacctctcacctgctgagcagcagcatctcaacctggatttcctcccgttcagatgtaaagtgagccgtccttccccctttcctctgtcacttcccaccattccccagaccagctcttctctcctgacttgtctgtttttgtaaagtctgtttcagaatggctcaagtttgaaaccttcaaattagcctgtcttctctctctttgtgcccttttacatctcagtaatcgtgaagttctatagattttatccctggagcggacagagaagacatcttattttttccattcttattccctccatgctttgttctgggagtggttgcttctcacctgggttgctcccaaaggaaggcacagctctaatcatatcgcttcctcatacctttgcagacttttcattgcctgttgaaataggtccagacgtttactctggaatgaaaggtcctctctgacttctcctcaacttctcttccaggtttagcaccctcagagtcctaagcctacctgcacagcaccactggctacatgggggtccttggacaattattttaaactctcagacctttagtttcttcatgtataacattagaaaaatgactagataaaatatctttgtgattgctgctaggcctatcattccatacatatttttcttatgattctctgagtgtaggtgtggtctgtcatactgctgtttcttgtacccgaaatcccctgtgttaggctgcttattttcaaagcctggttcaaatgctatttcgtcttccttgagaccttttcagtcccttccatacaaatgtgacctcactgtcttgaaatcccacaccttctaacatatatccatgccttctaacatatatcagagttgctatgttcttttcttttttccccagtagtaagctctctgaaggcagtggcaatatcttatttcatctttgaatccctagctgctaacaagtttctggtacttaatagttgcttgataaatatttaattgatgaataaaattatctttaaattttggagactcttcaccaaaaaagatgtgcaaaagatgtatactccacaaatgtatactttacgatgtaaagtttcacttcaagcccataacctcgatagactggattttgtgtttttataattcatgtaggatggatcaagctacatatctcagggaccgaaatcaagcccaaaactgtactttcaatggattacatctatgaaaactaacttgtttagctttaagtttcaatgaacatgagaatattagtgaaagatgacacaaaacaataaagcaatttatatttccaatgtagcatgtctgaaacctatcatagagatcttctgttttcatgatttgaacactgatttattccttggatagtaatttttttaactattttatttaagtttgaaagagcccaactcaattctaccctttatgaccagaaaaataaattactttgaatcttatggaaatgtccacatattagttatactcaggacagataacctcacaaaagataactggcaaataaaaagcatcaattgttggtgtagtcattaaaacatactgtttggaagaccaggcacggtagctcatgcctgtaatcccagcactttgggaggccgaggcaggtggatcacctgaggtcagaattcaggactagcctggccaacatagtgaaatcccgtctctactaaaaatacaaaaattagccaggcgtggtggcagatgcccgtaatcccagctactggggaggctgaggcaggagaaacgcttgaacccagcaggcagaggttgcagtaaaccgagatcgtgccattgcactccagcctgggcaacaagagcgaagctccatctcaaaaaaaaaaaaaaaaaaaaaagccatacatactgttcgttgtgaatctattctttgcaccatgctgtcctttgagttactgtaaccctatagggcagcagtccccaaccttttggcaccagggacgggtttcgtggaagacaattttccacagacctgggggtcagtggcaggggtgatggttttgggattaaactgttgcactacaggtcatcaggcattagttacattctcacaaagagtttgcagcctagatccctcacatgcgcagttcacaatagggttcgtgctcctttgagaatctaatgcctccgctgatccgacaggaggcggagctcaggctgtgatgttcactcacacccacccattgcacaacttctgctgtgagtgctgtgaggcccggttctcaataggctacaggctggtacatgtatgcagcctggggttgggagcccttgctgtgaggtatatgcagttgacccttgaacaacatgggtttgaactgtgtgggctcatttatatgcagattttcttctgtctctgccaccctgagacaccaagaccagcctctccttttccttctcctcctccttctctgcttactcaaaaatgaagacaattaggataaaaatctttataatgatctatttccacttaatgaatagtaaatatattttctcttctttatgattttcttaataacattttcctttttctagcttactttattgtaataatacaatatataacatatacaacatacaaaatacgtgttaatcaactgtttagattattggcaaggcttctgataaaaaataggctattagtagttaagttctggaggagtgaaaagttatacagggactttaaactgcacagggggttggcactccaacccccattttattcaaaggtcaactgtgttatcacttttcttttatatatgagaaaaatgaaccatggatattaagtaacttgcctacagtcacatagtaaataattatggagtcagaatttaaaaccagaaaacttttacatcaaaatgctctttataaatgtttttgttttgttttgttttttcatttcttagctatgagtaaagaccattagctgtttgtgttttgaggacagcacaagctttttcttttactgaccagtgtcactgtaaaatgacatggtgatggtccttccatttcagacttttaaatatatctttccgtcacttttgtgagaaattgattaatatgtaaaggaaacaaaagaaaataaggatgagaagcttaaagaatagtgaaaatggctaattaaacatgctgcagaaaagagtcaactttaaaagttaattcaaatactttaaagactgaccaattagaaacaaactcacatgacaaatcaggattcatggaaatgaaaaatgagaccactagcactgaaacgtgaccaacacatttttcttttcttttttcttctttcccacctgccacctctttctggtatttctggaattcactgttaataattactgtgctcaaagagaaaaacaggaaaaaattaaaactcaacaagacaacttacaaaaccaaagaggaaaatcaaaatgtgttgcaatacccaagctgcctttgaagcaacaaaacaacaaagcaagaatgttgtgggtgtgaatacaatgttatgggtcaactattgtgaaagacagtatggtaattcctcaaagatttagaactggaaataccatttaacccagcaatcccattgctgagtgtttacgcaaaggaatataaataattctattataaagatacatgcacgcatatgttcattgcagcactgttcacaatagcaaagacaaagaccaaaatgcccatcaatgatagcctggataaagaaaatgtggtggtatatatacaccatggagtactatacagccataaaaaggaatgagatcatgtcctttgcagggacatggatgaagctgaaagccattatcctgagcaaactaacacaggaagagaaagccaaatactgcatgttcttatttctaactgggagctgaacaatgagaacacatggaaatagtgaggggaacaacatacactggagcctgtcgggggagagaggggttgtggagagagcattaggaaaaatagctaatgcatgctgggcttaaaacctaggtgatgggttgataggttcagcaaaccaccatggcacacgtttacctatgtaacaaacctgcacatctgcacatggacctcggaacttaaaataaaataaatgttaagggtaagtttgtgaggtcctccatttttttttatgatagctgacaccatggtttatataaaactgccaattggtaaaaaaaattacttttaattggttatgaattaaatagtcctactttacataggtttgggagaatttaacagaagtttgctgccttcattacctcgggctgctataataaaatattagagtctcggtgacttaaacaacaaacatttgtttctcacagttctggaggctgggaagtccaagatcaagatgcctggacaatttggtgtctggtaagggcccttttcctggtttgcagatgatcacctatagctgtatcctcacatggcagagaaaaagagctctgatttcttcttataagggcactaatctcatcctgaagctccactctcttgcccttatctaaacctaattagtcctccccaaaaaccccccacctccaaataccattatattagggattagtgcttcaatgtatgaatttggtagaaggtggggcacaaacattcaggccatagcaggcttcttctgtagttaaaaagaatggaagggttctgagtctcagaatgactagaaccaaggtgtctggatctctcaagcagggagcgagagatccagagaccttggttgtagtccctgctcatattacccctccctcatatttattgtaacatgttgcaaaacctaaccagaaaaagaaaataatataattcacctcttaccagcaggcagtactgcacaattctgccacacagagcccagaaaaggcaggcagaagggaactccctagatccagaaaggaaaattaagtgacttgagaaaatatgtaaaggctaagactgggtaagtggccctgcaaattccttctagtcacagaaacatttttctgggggtcacctcatagggccagtggtccgtcagcaaatccagaagtatgttcaagttttgatcaaaactccatgttatactgatagctggtttaatctcgggtcctcccacagactgtttaatggtgccatagtatctaccaaaggcatttttgagtatggatgtccccttactcttaatggaagtcctggtggaggagcaagtgccagcagtaaaaatgtaattctataaaaggtaaatgttgattacaattatattaactccttaagaccacagtgatctttctctaagagcttgtagggaaaaagttaatggccctctgaaaagagagtaattcatttccttttatccactttataatttgcaaatttgcaaatgagcatagcccatgcaagttgagcaggcttctctcactgatgggtagcatatccaaagctttcatgcaggtaaaagcactggaaaaaatatgagagagttcatcttcttccttaggagctgggactgaaactggtccacaggacttcagggaggtggtttgaggaatcctacatggtccctgggatcatcatttagaagctttgagggaataaagattcttgttctctgaacctgctgtctgatataatttgaattgaaccttgaagcccctaaaaatctggatgcagtgaccatacattcagttccatttattcaacaagccaggcaaggatcatcaaatcaataacatgactgtgccatctgccttccctttgctcaccatcacaatgaaaaatgactccttaagtgttctgcaaggcaattaactctgaaggcagagctgtaatggagagaggctgagttacatttgtattcagaactttactggtaaaatggaaaggaagctgttgtccatattaatagatacataaaatagatacataaaaaaaaatgtataaatgggataatttggtattactctatttatgcataatattatacaactgcagaaacacagagctaggaagggcactgaaatgacatatggctcctccaactgcatgcagccacagctggtgaccctgtccagaatcatcttggacagacagactgtttctaaagacattcccaaaagtcatgctgataacttccgggactaattcattctgttatttaacagtcttcactgcaatttgattccattttcttttgttctctttcttcttgttctcatctctctagaaatagagaacagctaattatgctccctataataatccatcatgtggtagaaggcagttttgaaatcaccacccagccttcagttcaggttcaatacagcactcccagtccttccatctgggcctttgaagagcctggctcctagcctgagtcatctggtgactctcagaatgctcttcaaccttcccaaatattattgattcaagagacatgaaatacaaagggactctgtatttctgtttgttctggtaccctctgcaggtaccattgcctctgcctagattgtcctacccatcagcccctctccgatatacacacctccccttttgcaccaagagaatttcgaattcaaaggtcacctctttcatgaaactagtccccatgtttacccatcctcagtcctctgctttgctttttcatttactattataaaatttttcttacgctgtctccgtcccacccaggcgagctaagggcagggatgtttcccttattatttctgtaggggctaaattgtgcctacaacatagtaaaagacaatttgcttaattatttcccccacttttcttacctgtgcatgttggtgctaatgtcccagagtccaactcttaagctagctgtaaattcacactttctactgccctttgtcatgtaccttgctataaattaattatagatgcttctcaggttttaaaaatgataaaccaccctaatctctggcctgaaatttggcttatgaaaactttattgaggttaaatcagttccttactactaactaggcctgttgtctcagccccatccttgtgacctatttgtctcaagtcttagtagtcatttcgcaatacatgattttttctatgtttaacaaatttgtttcggtcttttgttatttttttccagatataaaaatatcactttgatactctggtcattcataagatcattgtttgatcatttttaacaccattctttttccttttctcaaaaatgaggccaggagcagtagctcacacctgtaatctcagtgctttgagaggccaaggtatgaggatcgcttgaggccaggagtctgagacaaacccaggcaacatagtgagacccccatctctacaaaaattagaaaagaaaaaaaaataatgtttcatagattctttattctcagtgctttaagcaggatcagagcccttaccacttttcttgatgacctgggtatgactcaccagactctgcttctgctccttggaccatccatttatagtttctgctgactcttgctaggctacctggctcctgtatcctttgttgtggatttttagatcacagttgttctttaagactgaaatttttcaagcactttgaaagtctctttttaaagcattatttgttattagtattttctgttacatataaaaacaagccaaatttttaaacttattgcctactgcattacaggttatattctgtttccctttatgtttccagtggatcactttagtcctcgctttattgcttttcaccttccctgatgcttcagaatcatcatgttttgtcagcttcttaggtgacttatagtcttgtcacagcactcctaagttccattttagctctttgtgcagctcttgcctgtccacttgaacttcccctcagccaacttttttcatatgcattaaaagtatttctcagaaatgcaaattaaaacactactgaaatactatttcttacctcttatgttggtgaaatttaaaaagtgtggcaacctagtgctgggaagaatgcaagctggtacaacaaccgtgttggaggggaatttgacaagacctaacacagctacacttgtactcttttgacccagcagtcccacttctaggaatttaccctaaaatacacctccagcaatatgaaactacatatgcatgagttatttattttagtacttttttgtaatcacaaaatgttggaaataacctgaatgaccatacatagggaagcagtaaaatgaatttggtacatgcataaatggaatacactgtacctgtaagaaagaacaaggaagaccttgagaaactcatatgaaattatttccaaaatatattaagtgagaaaagtaaagtgcatacagatatctagagtgtctgtccctaaagtaagaaatagggactataaggaaatctacaaacgtctactcatttttgcaaaagatgtaaagaaagataagtcagaaaccaacaagactgtttacctacaggaaataaagcgaaatggggtataaaaatggagcaatgagagggggagttggagggacacttctctgagtacacttttgtatataactctgacccttagaaaaaacctgacctttcacctacccaatcagttaggatgtgggagaacccaaaatgaaatacgaactgtaaaaaatgaacctaaatgtattcaaatgaataaataactatgctgggggtatagggaagaaaagagcaacctaagtacctttagaaaatgattattttgactatatactgtaacaccaaaagcaaccaaaaatatatatatgaatgtactatagttgtatatttgtttcttctacaaacaggagcatggaccagcaattctgacactatttaatgtccatgctaggattgaacaaagtaaatattttctgggtaatgagagctagttttctcactgtcagagaaaaatgatacatatgaggaaagtgagaagactagaatgaaccctgtggcattgggttggaattagagggatcagtatgagtttattcactgtaggtggatgcacatagaaatatagatgtatgcacgtgtgttggtatacaattgtatgtttcttaatgctgcctgctgagaggtcctagaagcaatgatatctcagtagcaataaatgtacttagcactcatctcttggttttttaacaccattctccaataaaatgaacaaggacttttgggtatatggttgattccagggctaagaagggccaaccacaagataagcttggaatatctaatggttccagaaaataagtactcaaaaaattgtgaagacatgttaaaaggacttaggagccaacctgaaggagcagctaatggccaaagttggaacaactcgaacaaagtaaataagtatagtattggattattactcaataaatgtatgatccatgagtccacactgaaagattgaatagataaagaatagatagttcgagaccagcccggtcaatatgataaaaacctgtctccacaaaaaatacaaaaattagccagccatggtggcatgtgcctatagttccagctattcaagaggctgaggtgggaggatcgcttgatcccatgagattgaggctgcagtaagctgagattgcaccactgcactccagcctcggagcctgggtaacagagtgagacccagtgtcacaagaaaaaaaaaaaaaaagaagtgggagagaagagagcagtggtttcttatagtagaattctaattaatggatgtagaaataagggaaatagaaaaatcaccattagacaaataccacagtagtaattgttaaaggtaagaaccattgatgaaatctaaagttaataggacaaaacacattgtaaaacaacacatttgtatagtcagagtatcttcccacaagacatttattgattacaaaggggaaagcagtaaatttgtaataaagaaccctagcagacatgacttatccaaatgatcaaggtcaatatagctagtaattaaacatatagaaatcatatgcctgctgacatgttgcatggagaagagcaaaatatcacttctgtggtattcttcttaaatgtgtaacaccaatgtaatcacaagaaaagaggccgggcgcggtggctcacgcctgtaatcccagcactttgggaggccgaggtgggcggatcacaaggtcgggagatcgagaccatcccggctaacacgatgaaaccccgtctctatgaaaaatacaaaaaattagccaggcgtggtggcaggtgcctgtagtcccagctacttgggaggctgaggcaggagaatggcgtgaacccaggaggcggagcttgcagtgagccgagatggtgccattgcactccagcctgggcgacagagcgagactccgtctaaaaaaaaaaaaaaaagaaaagaccagacaaatccaaattgagggacagtttacaaaacaaaaccaccaaaactcttcaaaagtgccaaggtcataaaagacaaagaaagactgaggaaataatacattggagtctaataacatatacacgcaataaaatcctgcattaaatcctggaccaaaaataatatataactgagaaaactggtaaaattcaaatagggtttgttgattactcaataatagtatattaatgttgattttccagtgttaatcattgtactctggttatgtaaaatgttttcatttggggaagctgaatgaagagcaaatgagatctctgtactcatttgcagtgttcctgcatgtctaaatttatctcaaagtaaaaagctaatagaagtattttgtcaggactcttttataagttggtcatattccaaagttcaatctatagtttacaggctctattttgtcatagaaatcatatttatttcattatatggttcctgggccagcctcaaaagcttacttaacctacaatttttatatatgtatgtgtatctctatttattaagtagtctcactgtattcttgaacataacatagtatagccatgttcccattatagaaaaatacccctatcttacaggtaaagaaatgaggttacagaaaggtttctttacttgccccacattttttattttaagattttagagcaagcaagttgcagacctgattttagagccaggtctgtgtgacgccgtatgctgagtttccctgctgaggtatctgaggctttgtctgctaggccactcactcacacattagctgctgaaaaggggcaaatcttatggacacttctgtgctgtcctctggaatctttcccttgattctttttcttttcctggattgttgaacaaaatgttcatgtttattttgttcatgagaattgccttgtttttagaaatagtgacttttaaatagtttgtggattttttttctctaattctgcctatcattttaaaaccatgttttatagataaatcaaaaagtgtagaactcctaatgcagcatttggagcaaagttaataaaattttaaaacaagaggatatatatttactaaattacactgtgcttataatgtgctgccatatttttgttaaaattttttaatgctttagataattaagcatctcaagactataatattaggctaagaagctctttcccattaaaatattcataaattatgttgacacgaacatggtgttctgaacaattataaggagtggggctcctaatgcaaatgtcattcctattatgactttttctgaacttagaaaatacattcaagtagtctatggaactgtccaaaagatacacagaaaccaaaaccaaaacaaacaaaaaccaccatttatcaggtacttactgtgattcagtcactatcataaaagtattttcttatgttttctcatttaatcttgcagtaactctgtaaggtagatactactgtgtctatttgacaaattagcaaaatcaaagttcaaaaacctaccagtagttagagagttcataattgacaggaccaagatatgaacctagtttttgtgtctactctacagtttatgcctttaatccttgtacagtactctagtgtttcctgacaggaaagcattaaatacagcatagaaaactaagaaggaaaaatggcaccaacatgaaatatgttaagcttatatttaatctgctgttttatgggagttttttttaaaggagcgagaagaaaagctacaagggattttaaagagtaattcaaagatcaaacatgatttttatcttttgtcccagagcacttcagattcaaacccaaggcttcaccgctgctgatgcacatccgcctctgagtctcgtaattggtaaatttacatcatgtgtgtcaccagcagcttaagaagggaacagatgtcagttttaggaaatcctgtgaatttcaggcttgctcagactaattggtccaattgataaaatgctaatgagaaagtaaattcaaacctttaccataataagtctgaattctgaccagtaaagatgaatgtaactgcctttctgaaattcctatttttcacagagtaaaaaacatatttttttctttaaaaaaataaagccatatttgtcctttaagaaagtgttaatgttgagctggtaatgtaagaattacctagaaattttaattgaaaatattaactgttttatacaattaaattcattttttggatttctttttttagagcaatagaattccatgctgtcacttgttagatttaatgtcatcttgataacacatctaggaataccaagcaactaactgcttaagcattaacgttttttccatgtcatataataagaggaagtttccatttacttataccatctttaatagaaaagaatggtacaagtcaaggtcaaagtctccttactggaagcagcagcctggcaggctgcttaggggtcctcatatgctttttcctctcactgaagtagtcctctttcctctcttccaagttcagtgtcattagcataacaggatcagacaactagagttcatcttgttcagccctctgtcttgtgccgcttccatcttatattttttaacatagccacagattgggaacacacagtttctcacagtaataattccacatcttatttccttttagtgtttggaatgtggccaccctgtgaatttttttttttttttttaattttttgagacaaagtctcactctgtcgcccaggctggagtgcagtggcacgatcttggctcactgcaacctccacctcccggttcaagtgattctcctgcctcagcctttcaaatagctgggatcacaggcatgtgccaccactcccagctatttattttttaatttaatttaatttaatttttttgtattttagtagtgatggggttttgccatgttggtgaggctggtctcgaactcctggcctcaagctatccatctgcctcagcctcccaaagtgctgggattacaggcttaagccaccatgcccagcccatgatgtgacttttatacaaacatagagcttatacattgaattggttgctgcccttttcaagactgttaccttggaaggtcaaatgtatatattcgagtgatatgcatcttagtattttaggtaagagaagactctgggagttacaacttattctagctcctttgccttctctttcatcttcttccaaaatttcttacattaccatctattattgccatcttcatttattccctagcccattgtaatctgacttcagtactcacttctgtattaaaactctcaccaatgaggttacccgtgaccgccaagtctcttaatagggacaattgggtgcactctcattttctccaacccactcattaccctaagagttatcatctgcctccttaactaaactaagagcagcatggaggcgagggccatctttctttatcacagtatcctctatgtccagcacacacctgatatcacagaccgtcaatgcttcactgaatgaatgaatgaatgcatactctctgcctctcattttacacacagagacacagaagccctaaagaaggcatgcagttcgcccagggtcatacagctgattattaggagaaccagcatgtgacctcaggtctcctaactcccaggccaatgccaatgggtttcatataatactgatgtggctcaaaagaggtttcggctccttttaaattgttttcaaagcccacaatatattcttttgaatatatctggtggcaagtctttattctttttttttttttttttttttttttgagacggagtctcgctctgtcgcccaggctggagtgcagtggcgcgatctcggctcactgcaagctccgcctcccaggttcacgccattctcctgcctcagccgcccgagtagctgggagtacaggcgcccgccaccacgcccggctaattttttgtatttttagtagagacggggtttcaccatgttggccaggattgtcttgatctcctgacctcgtgatccgcccgcctcggcctcccaaagtgctgggattacaggcgtgagccaccgcagccggccaagtctttattcttttaattggtggcttttatttttggaattatcctaaagctaccaggacacacaacgtgtttcacaacctataaggcattacaaaatctgcaaaggggtattaaaagagctgtccagtctacttttagcctaaagaatttaaggcctcatagtgggagcatgattagccagagcaatttgcataaaaatatacaatgggaggctttgactctgttctcatctgtagtagccaggaatccccaacattagtgggaaagagctaggctccttgggcagtcagatatttgtctacatgtgtgtgcctgtgagtgcatgcctgcatgcacaggtgctgtggacaggggaggtggaagaggggccaggggtgttgggatattccttctgggaaaggaggactcatttctcttctactgttcatttccactcatctcccaccaccacacacaaacatatgctagtctcccccgtagctcatggctatttatgttttataggttgattttctgattataaaattaatgttttcattgtttaaaatttaggaaacagaaacaaaaatcttacaaccccgagataaccaataaaacacatattttattcaggactttagacatatttggatttctttttacataagcggcatcattttttaatgaagttctgtattctgcatttttgctgaatgttataaaatgagtatttctccatgtcattaaaaattattcagcaatataattttaatgactgcatattgctttttatggatgtatcataaacttcctaattattctcctcttcttgggtatttatgttgttcccagaccttttttttttttttttttttttttttttggtgttataaataacgccatgaaaaagatttctgggtaaaacttttgtccacatctctggttatttccttgggacacattacttgttctgaagctagtatgtatgaaccatacttaggtttatcaatacatattgctaaattgtttttcaggaaaattttaccaacttttctcagccaactgaggtattttgaatatcacaaaaaagtaaattatggtaaatggccatactctctccctaaggaaaatggcagtgggacatagcaaggcagtcagattttccaaatcaaggggttgatcacaattgactagctattggctcctgcctttggcaaaccagaagcctggcagaggcctaatagaggaagagtctagcagaaatcatctgaaattaagataaggccatccttttgcatatgaagggccaggtagcaaagtataccaatatgtagctagtgcttttggaatatgcagtttattatttgacacatacctgcatcctaaaagcatttgaggtaagcactggttatctgggacccaactgctcctgaaggactaacccctgaactccccagcctgcataactaagtaaccagattccaaagcagagattattatcctcatattcagtgtgacctaaccaatccatcttgacattatttctgataatatcgtgcatatctttatatatcaatcaaggttttatgaaacgcagtaaaacattaaaatggctaagagcatagactctggagccagactgtctgagatttaattcctagctctacaatttagtagctgtgtgatcttaggcaagttacttaatctatctgtgccttagttttctcatcataatttgaagataataatagttcttttctttatagttgtcatgaagagtaagtgagttaaaacatataaatttctaggaacaatatcaggcccatagtaaatgctatatacaaatttcctactattattatttcgagttgctaagaattaactttagcagaggaagtaacattagataacacaaatattttaaagcaattgcttgagttttgggaataaaaggaatgctttttttcaactaggatcccaataatatttcggttctgtccttgaaaagtttttcttttttttatcatgattgtactcagtaaacttttggatctctcagacatatttgaaagcagtgtcttatactggggacaaggaccattagcattaccacccatctgatactttcccctttacactaaggcattattcccataatcttacaaatttcccataatcttacaacccagatataacaatgacaatgacaacaaaaggcatatttccttttaggacttttttttttttgccatagcctttctcttagattcatctggataaatctcactgataggttgaggttatcagagtgtgtctagaatttgacagtaccggtcctagaaaggcctggtcagattctttgtgtgtgtgtatatatatatatatatatatatatgacttttgacaatgaaccatttgaaatctaattccactgcatgatccagatgaataaataagctaaatgaaaagcatccaaggaaaggaactactcaaagaagcaggaactgcttgagcagcagaaattgacatgaccatggacatgagggtctataaactctgggctatcatggataattgaaagtcataattttccaaagggcttaattgaatatttgaaaatttgtatgaaaataaactgagtcaactaaataataataaacacagctaaactaaacaatataaatcttcaaaagaagaaccctaattaaaaagatagattgcacttcctggactttgccattctggttgttttcaatattatgccactgggaaaatacaactgtttctaatcaaataatttaaactcccatgctggggcttaagtgtgtgttctcccatttttctcttgctacttgttttggggataaagcagctcaaattattcagacaccaatcagatttatcatcctgtgccttttgatgacatccatctgtttatctaagaagccattaaagacttattgagttacagtgctatggagaaaattgggttatcatctatggttaaatccaattcttgcatctgccatcttttcagcttatgtggtatattctgaaattaccgggacttgcagacctgcactacaagaatacatttgcttcctagcctttctatgtcatttctagagaatttctaatgtatgcacaatttgtggttcaggaatatgttgacagaaagatgtcagtgctttctgttgttaaaagttcaaaagcctaatagagactatgccagcttaaaagtcttattcagaagtgggtactgtccaattccaacgtttgtgtttagactagcctattcaaaggaaaatttgactctaggtcacaaaggtagaagtgtgttaatcagaagataaagataaattaatatcaagtcaaaattcaaacggacaaaaaaagtgagagctcatcacaaaaggtgttaaataaacaccagcaagtaaactgataagacacaaaggatccaatcttgctagggaatgactaggtagaagtccagtgcttatctcacaagtcaagcagcttaagcaaggctaaaagtcatgttttctgagctggtgaagaagcagtggactgtgtggagaaaactaattgaaataaagtgaatatttgcagtttccgggagatactgttatatcctgactgcaggagccccagagaaagagcaactgtaaatcaggcagatgcttcagtttgccaatttttctagcatttgtcagagaaataatgaggaacccatcaggaaaacatttccttgatttgtttatgtaaatcaggccagaattctgggaaacccaggttttctgggaatcttcaagaattacagcatagctgctcctcctgaaattctagctgaacacactatttattgagcatttaagaagatctttccgatcatatttcagtttcctttctttgttttcctcatagtaaggtaagtaccctgaaatgggagacgatagccgtgcgatagctgagcataatcagttgagatctacatgccagatatggctggtttcagaaagatattcatttgtctgtctacctgtttgcttcctgtgaccttcatataacttctacctgtactgtcagcagagatgctgtttttgtgtcactggtgatgccacagtgaaagaaaaatcttgccaaggcaaggatgacaaggaaccaggacctagaccctaaagtagcaaatattgtggggaagagtctcctgggagtactctttcacaacctactaaattcatccaaaagtaaattttagtaggattgaaaaatactcagcctcttgttcagagtgagaagctatatactgtatgattttaagagttatgcctttttgtctttaccaccctagtcaacgcacaaaatacttgctctaacttgctgaaattctatgattaacaattcatttatttgtcttaagctttgttaaccttttaacatataggtatatgtagattatctgaccctttctttaaggtagtttctggctgcagaaagggaggagtgaggaccctttgggccagaaggagaagacacctcgtttctccaaagcttttgtctgtgatttactgtattgattgactatttaggttagcattttgattttcagtcaaaacggcagagggaaatatattggccacttttcagtcatttattcaaagaccaatgagactgagacaatacctgtggactattctctaatattttattgagtgactttattaattttagtgtttagataggagaaatgatattgagaattctctaagaaggctttcaataattgcatcgatcagttaaaggtgttgatccagatgcaaataactgctggaatggctaatgacaaggttctggaaatgtactaggaattactcaagacagaaggtctgagaggatcaaaattggtatccagaaatggcaccaccactctcccctctttcactgtttccatcttcatgtctcctccacagctcttcatgcttgtcaacttggggaaagtcatggttgatgcccttctgacagcctgctggagaagatctgttgccttttctggcagtcagtgacgtcttctgccacaactgggctttactctatggctttcttagaaagcagcatccatagctggaggagccttgagctcactggactgagtcctttcagcttgaagctgacctccctgattgccctgcctctccattgcagtttccgttctcacactgaccaatactaattgaaggagatagcatcacctactggtaatcaggtccctgccttgtcttaggttgccatccaataacaacttgagaatttataaaatattgtttttctttacaggtgtttcttgagtttgtttctcaagtactaagcactatcagagaaagaaatcaatgttaattatacacaaactgtaggaatacaaaagaacatttagataatcacttctctgaaggaaactacaatctcttcaggcagataatagataatatgggtatcttccatttctacaaaagataaaaatgtaggtgagagagaaagagcacttactaaaagttaaatggagtcagcagaacctgagatttccaagtgatagaaacctggacaggcagcagaggtggagaagcacagtctaagtggagagtcacatgagcaaaggagactcagaaatcagagttctttggaagtgggaggttgctaagaaagatcgaaaatgccaggaaggcccttacttccaagatgagcttgaatttgatctggtaggaattgggaaaccattttggatttctgagcagggatccaagctttaaatgcacagttttgaggacatttacttttctggagtatacaaactcagctgttaaagagtgggatcagaagctaaagatcagctaggaaaaattacagtaatccaggcaggtgagggtctagattgcagcagaaaaagagagtctctgatgaattcaaaagttattggaaagtggaaattgataggacttggtgacaaattgaattaaattgactaatcatttattattttgtgcatctcagcattctacatctctaccagtgaactcattaaagagatttttatgttaatagcgaagtttttaatgtaagttgatttgagagatcttttctggttgaatacagttggcaggctgttggatttagtaggcaaggccacatttatctggcatcattaaaattaggtaacctaaataaataaaatatttagacaattgaagcttgctgtcattgcccaatttggggaggcagtccagagggactggccagatcagataccattctgtggataagttatcctgagggacaagtggagaaacaaattcaggggcactttttctaagaacgggaaggggactcccaaagaaattccccaaactaagacatcagtctctgagacaaaatagaacatgaaatgaggatagagattcaaggatctaagtagtccattcattaatgaaataatattacttatgtgcattgagtacctacttccgtgctgaaagctttgcataggtcatttgttttacttgtatgtattgagcacttactaggtgttggctgagcaaagaacctaacaggtatgttcccagcccttatagagcttatagtctggtgtgggagatagtcatcaaacaaataattatacaaatacatacttagttacaaattgtgatcattgcagtaaagggaaatatagagtggcatggaggtaaaacaagggttctccacttagatttcacagtcaaaaatggtgttcctgagtaaataatattctagcagaaactttgaaggatgactgggaattagccaggcaaagactaaaaggatgagtgtcaaggacactgaaaggcaaagtaggagatcaaatactgggaatcttgaagtcggaagtaggtatttggtttaagctttggagcaaggtgaaactggaacctggaatggctgtaattacaaattgtcctcagattacccagctcagaatctacagacacacgctaaatgaaaaaggcagcatatttaatggtcagaacatcacaacatacaatttgcagtcagatgaatgtggaccacttcttgggtgttttatcctgggaagacacttaccctttctcagctttaatttttcattctgtacaatggggctaatactacttatctcttggggattgtgaaaggctcaaatgagataatgtctgtaatatacttaattcagtacctgacagacaatatatgctcttccttcatgtcaccaagtcttttgttattctatttaattcatatttattttgataacaacatgaagatacccacatacctagcaaaatgtaggaactttataacaggcattttctttgctgctcagaagcttatctgagtcttttccacctattccctgatctgtaattgtgtttcatatttttgaggctctctgaagtgaaatctccagattgggaaagggttaagggattcatatgtaaatagacatagaattcagtgtgtgctcaattaagatttgatgaatgaatgattactgtataattatagagatctgacagtgataaccatagttaattcattgctaaggtcgtgtacattgaaaaataattttaaagcattttttagtaatttgtgtttttaagttgttagtaaactaaattgcaaccttttgttctctgaatattctcttaactataaatctaccatgttttaatcagagaaatgttgtgacagttccaggaaaggaaacattttttctgtttaaaacatttctagcatttcagccaaacaatttatctagaatggttttccctttaaaaggaatagtagacaattagaagcatagtacagtacattttctgccttatggttccaagccaaaaaccagagaacttttgtgctttataagcaattgtaaactaaaatgagtaactggtatatggtaatagactaggctttgagctgctattaccatagaatacttttccggctttcttagaagcacgagaacaaaattgggaagaaggcatttatctgattgaagctaggatgctacttgcattgtacttcactttaggtagaaaggcagtcattttatttgctgttaatgtgaaaagagatatcacttctctttagaatgtagccagcaaatcagtatctaaagcctatacacatggctagaaacaaagctacccatatagccttagacctccctgaacctgatcaggccccaggatactgttctgctcatcacagtgggaagctacaggtttgctcaaaccaagtccatctatgggagttactaaaacctctccttagcacttctccagaatatggaagtttgggaaagcccactccagggggtccctacatatacctacataaaagcttcatttatttgtataaacaggcagatcagaaataggttagtgacaataaatgggtaaagtacactgatgtttaaatatttcccttgcaataatacctggatgagattattttatttggactttgggaacaaaagcattgtttggcaatatttaaatcctagtaaatataaacagtaagcaaattttacaattaatttaaatagttcagccaaccacataactatataaatcctatgttagtttaatctctctagggacttggcaatatttttttcttgataggcagatttcacatatattttattcatttattcaaaaatattaactaagtccaagaaaattcctaagcaccgtgctaggcactaatgccaaacggccctgcactaaatggacacttagagtcttgtgtgggattcagacaggaagcaaatagtgtctcagtattctctctgcagtatccttccctcttaagacgactcccagatcagaggggagcagctcctgtagaagtggcccagggctaggagacctgccactccccttctccccactgccctctcagcgctcctctgtagggctctgcagatctagtttgaagattgctttacatatggttctgatgtgcagaaaaatggaagaatctttgctgaatctatttcatttggactaaatctgtttcagatcttactggccagcctcaccatactggccacacacatgcaagaaaaagccttcattccaaccaacctaaagccacactatttgctcattacaatgaaagacataatttacttattgcatggcttaggccagagagaatgccagtaggaagactcttctcccaggaaataaatagattataagaaacaataagaaataaatagatgtggacaagaagcctcaatatgcttacctgtctacacacacacacacgttattgaacctgatgaagggttctgaacttgcagaataccagataattgacatatcagtgcatctctagtctgggtagattaatctggggtacaagtatattttctctgttttttatgttgttgttgtttctacaagcagtttccttttgcatttcctctgtgcaaaacaaggacctggggatctgcttcatttataattagagcaagaaagtcctgcttgacattgtattggagccttacagtttcaagactctcggttgcataatgcatgtgttttgttaataccgttaataccatgtaatactagtgcccctgatactgtgtataaatgaggcatacaagtagctccttcgcccagcagcaacatggtctgtacttgtagaaaaatttacctcctgaccccctaaatattgattgtttgattggagaattgagagattccagtggtagggatcagaaaagatgaaaaagatgaaaatgtgtaggcataaaaatagtatgaggaagagaaaaattataatggcatcacatatatgttgcatattctatgccaggtagtgttaaaaaggtttatgtatgtgcattcacatactcatttaaatattacagcacccccccaggggatacacatacttactgaaattttagtctgtgtaacatagcaagatcctgtttctactaaaaattacatttaaaaaaatagctgggcatggtgatacatgcctgtagtcccagctactcaagaggctgaagttagagaattgcttgagcccaggacctccatgttgcagtgaaccatgatcgtgccactgcagtccagcctgggtgacgtgcaactctctatctcaaaaaaaaaagaaagaaagaaagaaattttatagattggggaaaccaaagtaaaatgccttggccaagatgacatggcaaacaagtgacagagtgaggatttgaacccagacagtccagctgtcaagtcaatgctcaaagcatgatgctatgtagccataggagagccctatatgcaggtagaggaaagatttctttataaaccaaaagatgggtgtagactcagtgagtctgtataacggggtaaagggagttgtgagaaagggaaccgagaattttgaaaggaatagagggctgaactgaagctgaactggggaagcccctgactgtggtaaataaacagaaaataaaaacaatagtagtcacttagctgctttaaatcccctttttagcaatagattgtaaatgataatcactgtgagttttttttaagggaatactagagattctggtccaactgtggttcgagtggctgcaaggaaagcattttcaaccagcagcggaggctgcagtcattcacgagcatcaggaaatcaggggagcctcggagaggctgtgggtgatggatgggaacaagttgaaagaatagtatgcagaagcctggggtcagggtggggcagtaaaagctgagctcaggagccaggaaattgttcagaagctagaaatcaaaagtcatcagatggtaaaagccaacacagcagagatgatgccaaaagcacctggaaacaaggcaaaaacagcttcagacaggagaaagcagcttatattgctggactaggaactgaaattatttcccaggataaagtcatcctgctggaggctttcagtagagtgcttcacctcaactggcagtggctgtcagccaaggagaaacagatgcaatctgtagctctaactgaaaagcctgctgtcgcaaggacccagagatctgagacagtggggtcaacctgagcctggccatgggagagggtgaactatggagaaaagtgaaggaatcccaggcttcggctagagaagacctgtgataaatagaaaggggccaggtacggtggctcacgcctgtaatcctaacacttggagaggccaaggcaggtggatcacctggggtcaggagttcgagaccagcctggccaacatggtgaaacccagtctctactaataaaaattttaaaaattagccaggagtgctgatgggtacctgtaatctcagctacttgggaggctgaggagaatcgcttgaacccagtgggcggaggttgcagtgagccaagatctcaccactgcactccagcctgggcaacagagtgagactccatctcaaagacaaaaacaaaaaagaaagggagtggtactgtggaactggaagggcctggaagaatttgatggatgttgtagaacatctaggccaattgtgtccctgtcatttacctaatcagtattggatttttcatcctgagtcttttgtgcatgtacgagtagttaaaccctttatgctcttaagtatttatcttgctgcaatgtatggtaatcaatgaggtttgaaaggactgctttagaagagaaagagaggaagcaggtaatcataagagttgttttccccttgagaaaccaaaaagaacaagctctgaatagaggtgtgaggccccttcccactttaacattctgtgagtgtctgaatgtcctaatccccccggggtgaaaatgactcagaggcaggtggtacctactgtatttttgtggagctgtcctggggcctgtgccctcaatgcgtggcctgtcttttctgggacttcaggctctctctatgaagggctttccctgttttatgctcagggcattgcctagctaacatgagcctatctctgggtatttccactgagggtaggctgcgtatccagctatacatgggagtaccgtagttccagggccaccactagctttcattgcctttgagcaaatgctgtcctgctccagagtttatggcttggcacagagtggaatctgcatttcagccggtgcccagcccttagccaggagtcttgtgcagtgatgaactcgcacagccatttgcagtttgcagcgcccctatggattgcttctgtttctgccggatggtgatgaaggagtgctccaacacatcaactctgtagcacaatagctttcacccacaaagctttgtttcctatattctctctggcttacctaaccaaaatattgaagtcatctttgactcctccctcaacctttacattcagttaaatactagtgttgatcccacctctgatttctcaaagactatttctgtagttcaaaaaccaaaagaactaacattgacagagccctgccatatgctgggtactttaggtctcttttactcattataggctatcttcttcttccattatgttcatttcgtaaatgtggaaagcgagacttggagagtttcactatcatggcctcaagctagtaagtgctgcctacccaggtctgtctgcttctaaattccaagctcacctgccctgcattacactgtgctcatcaatctgctccaggacctaccattaaatagctttgccaaccccacacttgccctccaccagcctatcttccacactggtgctggaggtaactcccctaaatgcataccacctatcctgtcacctgcagatttttgaggaccagccatttctgacaggtaaagttcacccttcccagcctgtcatatgcagtctttacttatttccccagccttggttcctaacactcatgccccatctccaacaccatcagactgagaccaacacgtccaggccctggggataaatggtaaagggaagatgttgcaggattggcactcagcattcaaaaacagttgttgtctctggggaagagccacaaaaggccttgaataaacactgagagctgagcaaataagcacatgcattagaatgcctgcagggtgcccacactagttaggggtgtggcgggctttgggagaaaggctggtggtcaggtctgccccactgagggctgctgggaagatattcaccgaactgcctaaataagtggccttaagacgcccctaacccaggttctgacacccacattgtacttcctagtcacactgagttagttgttctttcccataggtaccctgtattttcatacttcattcacatgtgctatttcgtacttcattcacatgtgctattttttcagcctgtaagacttgctgtcatctggaaaaattttccactctccagggtcacacattattgtcatcttctctatgaagccttccagactccttgtaggcagtgttacaactctcctttgtggttttatagaggaagggagaatgttttggtaaggaaggggtctgagttggagaatgagaagaggatgaggagtagaatggcgtctcttccccgcagagctcttaggtctttgctcattctggtgcagtggcattagccactttgtatggtgaatagttttgtaaaatagacagatgtctacaggtacttcacccttgccatatagcaagcttttagtgctccctgcctcccaatgggccgccagttatttatggaaggaataaaccagttacaatacatcatagctccggctgtttgaactttctggctctagccatccttgcccatgttctctgcccataaagcctttacagatgcctcaccactgtcatggtctatcaggggaacagatgccagtagctatccaagctgcgacctcttgataatcccaaactcctgttctctaaggcaccagcgctgggcagggctttgcgcagatggtaggagtgcatcttctggaccctggacaactctatacccatccaagaacaacatccatgcaagaaactctttacccctcctgcacatccagtctgcaagctccaatggagaataagttatatttcttcccccactatccttcccactccatctaagacctgtcctcaataaaactctcttctattaggaaaacaaagctcttgtgcatatgagtgaatgagctacagctgttgggagtgaggacaatcctatctttagataaacaccccacagaaatgggtggatatgtgtaccaaaggacttatacaggaatgttcacagcagcataatttttgtagctaaaaactggaaacaatctaaataaccatcaataacaacatggataaatgaagtgtagtatattcatacatgggtatggtataccgtaatggaataaactactgctacatgcagcaatgcagatggatcctgtgtgcataaggttgagctaaaacacccagccacaaaagggtgtgaactatatggtttcatatgaagttttttaaaaggacaactaattaatagtgctgggagtcaggaggagagttatatttcaggaggagagagcagaggggatcttctagagctttggtatagaaagaactgatttaggggtgaacgttctgcctaaggcctgggccttctgcctgggtaagaatctctgaccagttcagaaatggcctacattcatcagatgcagaggcagtcttttcaaactgtccattcagcctgcagtgggggcatttggaatggatatgaagaatgacattttgagtagcttggtgtccactctgctcatgggacagaacctaatgattgattcagtaagtaaaattccaggaaagaattgcgtgcatttagatatgggcttctgtggcaacaatgctagagctgaggaaaaatggaacaagctgtcataaacaggcaaaagaaaatagcagtttccatctggaccttacctttacatggctgttttagccgtgatcattccaaaatgaatttgaaatcacattttacctcatttctctttatatctggcccaatatttcttttggtaatccatggctatgaagcccttataaacagaatcctggcctattttcaaggatgggagatatgacacaccaattaactctaggaaggtttgaatttagggtggttttatttcaccatgcagaatgtttaagccatatctcaacatagccagctactgcaaattccaatcccagaatcacattgctcccatagtggatcatctggctgtcaggagattctcagcaaacaacaacaacaacaaaaagcattaggccgcttcttcctaattatgtctctctctaaatatctaattatcattgagaacaaattgcatgttacagagataatattatggggaatcgttaatctgttgggcttctgcttttgaattcctgagtcggtactgcagctgctgaagcaaaaaattctgccacctggacacttcattatgatttcatatttaaatgcaaaaaaactgccgaagagaggttctatttgatggacttggcttcttcaggcatttcgtacttagctacgcatcacatgtacaggtcttccaaatatcccaggtacctgggaatagtgaataattgagcatttacagggacagaattacaagggaacaatgggaatatagtaataccaataaggtgacagtggaattgacttctctaattatactttctttttatccatgcacaaaggtctgcagctttttgtaacattcctcagtaactgcataggacttccttaataaatgctgatccaaaaagtacacattcccaaagattacctgataattgcacctaccataatatgcttaaagctaattaacattcagacttcactttagagaatagaaattaccaggtacttatcccataattacatctttgtgcactcactattgtaatccctggcattagctatgtaattaaatgatgaacagtgactgtgtaagtagagagtacttatgtaaaatttgtgtcttatcaaaaataaataaataaacagattcaaagactcaggtctcatttgaaattccattgttctcagggagattgtatagcatgtcaagaattgataataatactgttagctccttgaaggtgggaagatgatagtactgccactctgtcaggaagatgcccactgtggttcatcttaccaccagggatgagcggcgccaagcaagtctcacggtttttttcttggcatgcctcaaataacaagtacttagacactgtcttactaaatctgacctgtctctaagctatgaaatccagtagttttttgtcagatgctttgtgcaagaattcttttaaaaaaataatgttttcatctgatcacaatgctaacatatattcatcgtggaaagtttgtaaaatattgaaaacccacagaagaaaatagaaatcacttataattccttatcaatgttaacttttttccgtatatgctttcagtctctcttgtagatgaatctcactgtatctacatatatatgtatacttcttgcgacctgcattttagaagcggtatattgtgaacattccaatgaagtattattgtcttttatcatatttctcatgactccattataatctgtaatattggtagtccctaaattatttaaccagttttgatggacgtttaggctagtttttcaacattaatttctatcattttactattcaccatgtgagggttctctaaaagaagttttaaatgttgtgttttcatgaaaacatgttaaaggtcattcattctaagttattaccttgtgacaatgtcagtgcctgcgtttgcatctgtattcacagtgtgctgtgctgcgtgtcactttcattgttgtgagctgatgagaaaggacagaggtctgcttaataagtaaatgatcatatagttggttccaccgagtgaaaccaaaggacctcatagtatgcaggacaaatggaagttcaaatagcaaaaagcagtggcaggattgagccatcacatggaggtagcagagatacatcaaactcaaaactaaaaaagaaaatagaaacccaagaagttgataccatattcacagcagacagcaatcaaggctctcataaaaatcattagtttcgagaccagcctgactaacatggagaaaccccgtctctactaaaaatacaaaattagccgggtgtggtggcgcatgcctgtaatcccagctactcgggaggcagaggcaggagaatcgcttgaacccgtgaggcggaggttgcagtgagccaagatcgcaccattgcactccagcctgggcaacaagagcgaaactgtctcaaaaacaaaaacaaaaacaagaacaaaaacattagtaactctaaattaatgttgttgttttgaatgtcatgtgatttgtaagtattgtatttaatttgtagatttgttttacatttgtttggattgtatagttgtataagaaccataatcctaaagagccactatgtaatttcatattttcatacatctaagtaacagtaaaattaatttaagtcaacagtgagagtctgtaagaagtttccatttttaaaacagatccatacattttctcaatttgggttacattgtcctcatagctacatcattatgcatatccttagaataaattatttcctcagggaaatttcttaaacataaaattattgtcaaatgttataaacattctaaggcttttgatgtttctgtcaaatttgagtacagactgttcaagttacttttctccctttagtttacccttcatttttaatactttctgcagtagtacattcgttctagtttgccaaatatttattgagtgctaaccatgtgcaggcatcatgtattggcattgactagtgaacatgttaaaaatgcatcatcatggaccccacaccagaccaactgaatcagaatctgcattttcaaaagatccctaggtgatacgattgcatattcaagtttgagatgcattgttctaagaactagacctggaggtcgactgtctctctgacacttcctcttgaccatctcgaaggtgccccaaacacaatatgtttgtcttagttttgggagctgctattacaaaatattacaaaatatcataaactgggtagcttataagcaacaaacatttattaccctcagttctgaagttaggaagtgcaagatcaaggcaccagcagatttgctgtctagtgaggggcagcttccttcctaggtggatgtcttctcactgtaacaacacacagtagaaggtgcaggacagctttctgggctctcttttataagggcactggtccattcatgagggctctgcccttgtgacctaatcatctcctaaaggcctcatctcctaataccatcacactggtgattaggtttcactacgtgaatttagggggcggggagaggcacaaacattcaggctgtaacaatgctcaacatagagctctttttttttttttcaccatgcctagttctttttccagttttcctcttctcagtgagtggcatcaccatccactctctcatgcaaaccagaaaccttcctctactttaccccccatatctaatttatcaccgagttcactatctctcacatccctcctattttttcactctctctccactgccaccctccttgtctaagctactcttgtgtgttgcctggatattttgcagtatcttctgaactggcccccctgcttccattcttatcccctctagtttattttccacagtaagttgtggaaaagagtaatcttttggataggcatattggaacttatcaccagcttgcttaaaacgtccaaaggaccttccattgctctcatgataaagacagaaatctgtaaggtggtcccacgagattgagtcttgcttgctctctagacttgttctgtgccgagttctctaaggtagcagtcctctctcactttgctttctccttacccttcagtttagctagtgaacttctattgttccttagattgtagctcaatcatttcttcctcagaaaaccttccctgacctccctaattagattctttcctcttgttctgtgatctcaaattacacaacttattcccctgcgtttttatcactgttgtaactcaacattcatttttgatgtctttgattaatatctggcaccccattagagtgcaagctccattagggcagagaccacatctgttttttcagggccagaagatgataggtgatgtcttacaggtccttaccgctctggctctcttcatgagtggttcttccagatggaatgcccttctcctccactgtcacttaaataaataatacctgtctttcaagattgaattaaaggaacaacccctcaatatgatcttcctggcggaagtcctcttcaaatcctcttataaggtacttattaccttctacaataattactatgcatttttctctctctgtattaatcaacgtaagtaaccattagttgctgcaaaagataaacagaagttgaatttcacccatacccagttcagcttgggctaactgaagcacttcttcatccagtgacttgacgatttaggcccccttcatcttatcaggccattttcctagcatgtggctcacaaggcagccacaaagcatggagaggcctcccagtctcttaaatgacaaggcacagaaatggcatgtcacttgtgctgacatttcgttggctggaactagtaatctgactcctcctaaatgaatggtgcagtggaatatagtcccctacatacccaggaggatgcatagagctagatatgagtgaaaactagtcatctctaccaagctgtagtaaactcttgaaagaggacaagatctaagcccaaatcactttcagaacactaaagtattcaacctctcccatatttgccaattaatacaagttgctgattcaatgaatggctgaggatttcagaagagggagacaaaagcagagagaagcagaaaggcagatacagagcagcactagaagacagcatctctctcttagtccattactatttgtttcagctacttacacacttttgggcagtgctaactaaattgataaacagcctgccccacccccacccccacctcccaaagtcagttttttggggtttttgtttgtttttgagacagagtcttgctctgtcacccaggctggagggcagtggtgctcactgcaacctcagcctcctaggttcaagcaattctcatgcctcagccacctgagtagctaggataacaggcatgcgccaccacgcaccacccgcagtcagtttttgttataatagcttggcttcctatatgtgatattattgaaaagtttcagaataacgcccatgtgctggacagtgtgcaaggtgttttacatagactgctatacagtcattctttcagcaattctgcagtacaggcattcttatcacagaactcacaattttctgccttagaatgtgcattgaactctgtctgcctctaaaacctgtgttcttaaccacgacaccacattgaagtttattaaacatccgaatatttatcaaccctgagaatgagcgcatataagtaatgtgattaatctacccattataatccctgtgacttagccttgggaaatagactctaaggaaacacttgtagaattttgccaagacagtagccaaattccaaggaatatatgtgtatttaattaagttacatattctaaagccagggtgatgagcaatttggataatgtttctggtgtgtgtgcattgggggagtggtggtttccagatgagacaacagccacaaagtaccttgtcatttcttccattgatatatatactcatatatgtttgcacagataagactagcttttggctttatgcttagttttatgtacagtacaaacattaaatcgtgaaggtgttcatcacaggaaaaccagagaagccctcgtaagccttataaatcattgtccttatacccagctcactgtgggtggtggaccgttagagcacatggggacagagtggcagtctgtgtgatgttaagaatgcaacctattaagcagagaatgagaagttgaaggattccatttttcaccagctctaacatggttaatctttaaagctatttattgaacacaaagacatttgactgagcactttgtagtatgcatctttctctaccactctcattcatcacctattttcaccgaatctttgttaagatttgcagtaatggtgctgtataaaagggcctttatgtgactcacagtccctataaaatatgattttttttcttcagatcatcttttgaaaattgctgctgcttgttatttcacatatttttttccaagtgcattaagtttacctgcaacgggaaaagattatttagagaaacgtacactttctatttcctttaatagcttgtgttatgatatgtttgatagttcatgaaggacactgtcagatttggagaatgagccaataaactttaggtcctaagaaatatagccccgtaatgatgcctactcatatgcagagatattttatcagcttaatggtaccttttagtgtctgacaccttcggtttacaggtttgctcgatggcctgtttgcttctgtgccaaattagtgttgagggaggtttctgatgagaagaatattcagtttggatattagagttatggccgtcaagttggaggcggtcagcctggtttaatctcagatggtaccttttactgcagatgccgactggggactcatgaaatgcccaagcaactcttgtttggctgtaagggtgcaaatcaaggtgtgtgggcaggggagagcatctcttgcctacagcattaacagacattttattttgtaaaatatgttctatcttccccaggttaaaaaaaaaatcatatgctcatcttattttaaacagattcttttagtggtaaatgaaagcttgtaacctgtaaggtagcatttatctttatattcaaagcttgggcagccatggaagaacattgggagtgaggacacttataaaaggaggagaatgtggggtcaggaagcagagaatgcaaagaatagtgttctggaagaaaaagggaggccaactgttatctctaaactgcctatgcctgtgaacttcatccaagaacagaacatccaaaaaccaggcttactagccttgtctttctttttggaaatacagagtttcgcaaataaataaggggatacttaattatctccaagcaaacatttcatgtgaacagtatagcaaattatattgtgcatatataatgccaatgtttggagcagatgaagatgactgagttgcaaggtggaatgatgatcgtgaatcttctgtcagttactcctctgtcctggatctagtcattatacatttatttttcaacgtcttctgttttaaaatgactcttctccaaatactagatcacttagttcctttttgtagataatttgtatccttgaaatggacaggtacttcaaatatcacaagaaagggtagctttagttttcttttgttttaccggttagattatctggctgaggttgatttaactcagtcaggtaagctagtaaaagtttgtctttccttaataagactgattttttttgttgcatttatccaacaatcttgtatattctaaattttgtgcagtttaaataggacattgttaattcagttcatcaattcattacaaatgtgcagtacggatgctcacacatttacttcctgaatggtagatgcagggtaagaaaagcaaaaccagcttcatgatatctgtgatcaagatacatattaaggtgaatacggacaagattctactgagtctgctgaaaccgtttcaaatattttggggttttgttgttgttgttatattactctgtttactctaaaatcaggcacttgaggctttttttctcgcctcagaaagatatttctgaaattcatgacattgtaatggtgatttttattaaagcaaaatttgatggcttttgtttatgagacctgccaaacagtgcaaacacaatcagttaactatttcctttggaaggagtatggtaaatttttgtgtaagagactgtttacccaataaggggggatttatagtttccaaaagtgtaatataaaaacaatcttcagtttccccatgttatatatacatctagtaatatactttctgtcctgtgtagctaccagcaattttaatatatatagttactcttaaaaacttttatatgatacaccacttttttgttaccttctaataagaatagtggattctaggctagcaatatttcatgctgatgatacatatcttgtaagactatgaactttttgaaagcaggcatagcaagcatataatttaaactctactgtatgcattagagattacagagggcctgagtttcctcaagccacccatcttattaagtcatagcactgcatactacataatggatttgaattccgattgaaatcattcatgatcagggaatatttactctagatatagaaaattcaggcagctgggaaaaaagaagggatcgagttgtttcacaagcctgcttatgcgcctgtgtttgtgattgtaactctaattatatttgtactgtattataatgaagtaatttaattaaatgttccataagttgataaaatatttgctcaaaagttgtttatattaaaattatattaatactttagagagactcaagacaagttgcttttaaaaattgctattgaattctttataaacatatatgtcatggaaacctagggaggagagaatttccataaacagactatgcttcattgtgtgccaatgcctcaataataggaggaaaataaagaatgtgtagaggccatgggcttggcatctcaggaaccactgctgacaatgcaggttcgagtttcatcatatagataacggcaaaagctggatttcaatatcttaggcatgaggttgagggaaatgggggcagaacatggagatcatgattgtgtggcatcattcagcagccaggtgaagtggagaggcgggagttatggagaagttgatagtctatcgctgggaaggactttaaaagagtatgtatgagagaaaaagactttaaaagagtaaggtgtttaatgagtatgatgcagaggaaagagcaaggtttcggatttgcaatctgtgtgccttttattaatgtatttaacctctgagcatctagctgctccttctataaaactgaaataatatatgactcaacagattttgggcgaataaagttatatgtagatgatatagcataattcgttctttttctttatatcttgccttcttctgttggaagactgtattctactgagcatgttgatgggttagcataagcactttgggtgcaggcctggggaaagctgaatagccctggattcagaaaacagagttccagccactcctgcagatgattcaggaggctgcggctgggcagcagaggtggcagtgggcagtgaagggctagcaaatgagacagatgcctggcatgaaacgcgactacttccataggacccccacgcaaacaataatttctgtcatatctgttgaactcacagatgtttggtgtggatatagtgtgaaccaaataaggacctttgtttcatgccagggtcagtagggcaaaggaaagtttctcagggaagacaaaattcaaaagaccatcacaacttgatattcaagaatggaccaaaaaaaaaaaatcttaggaaagactttgtacttctacaggatgaggaaagagacaaggggaatagatggaaatttcagtaagacttcagttggcaaggaagccctgagctgactcctgggccacatataaagccaggtgtcttcaacataactgacatggaatcagtgatgctaattagcataatattagatcaaagatgcaccaaagggcattgttgaaggtccactgtccacaaagtggttggaggaatgggactgagatgatggctgagtttcttttctttataggacatgcaattaatgactgcagccgaatttcggctcttgtgttccgtcttcctaattcctgagcattggtcatgaacttgctagccttgccacaatttatccagtaaacaatgttttactctcacctttacagaaatctaagagctttgaaattggctacatatagatgtaatgtatgtagggcagggagcacccaagagaatttttttttctctaagattacaagatatttaccagacctctgaaaaaaattgctggagttataaatgtgctgggaaccacctaaaaatcccaaggaatattagtttttgaaattggtgccaagatattgaccattgttgcattcttataaagatctagaatatgttcttatgaaagaaatttttatcataattgtttaagtcagcagcaaaatcgcggggtgtctgttatgctacccacaataatactcctggacagagagaatgacaatatcagttctttaaaaatccaacacaaatatctccttccttctgtttgtacaaaggcaaccataatggcttttgcttccggcagactgaagtaacatgtggggtctctgtagaaacacttggagtctacaaaatgagcttttagcttatcccctggtagttaattactatacctctaggtcaattagatggctctcaattgctcagttgtaactgtggtttcactcacaagctgtgtgtggtaattctagtttacttgttttcttaagtaaaactcaaattgccgtgtgcatgagatccagaataatgatcaaaactgaagtatgctgaagtgggctatgtaattaaaacaatttcatcaaaagcttcgtattttaagttgccattatattggtaatgctctcttggttcctccaaagaccatttctaaaagtaaaaaataaaataaaaagagcattttaccttcataactagcactaataatcagatatttgcatgatctgaaatgaaacaagaggtacacagtccaaggtggtcgtgtgtattgaaggaacaacactgcactggtccaccggggatacagctgaataacctggaggtatttgttgtcattcagtattcccgggtgcagtgccttttcagctgccgcaaggttaggcatacaggagcgtgttgcacacggctgtgctcatcctgccgttctaatgtgaatgcattatttccagctttgtggaagctccagcacatttataatcactttctactcactcttgactatgactccttcatctgacaaaccctcagtgaaacatcttctgcctgtcactgtccccctccactcaggaaagccacagaccttgtttgtgcattcagcaaacacttactgaacatccactgaataccggacactgctgaattccagggatataaaagcgagtaagactcggacccggtggtcaaagatgctaatgtcttgtgaagaagacagacatttagacaagtaattacaataaagtgtaagaactcttactcaaagagggaacacctaattgtatccaagagtgatgtgcagaagaggaatcagggaggccttcccaacggagctgatgcttgaactgggtctagaaagatgcaaggaatttgccaagtggttcaaatgagaagtcaagatattagcagacaggggaaagaacatatatgaatgtggaaaggatggctttgtgtttactaattcgatctaccaggtggatgaggttgccataatccaagaaaaggaatataaaaggagagaaggggatgtgtacaaggagcccagttagcgtcttctgtgttattgtcactgtcattatcatcatcatcatcatcaaaccatgtttgtaaaattcttctaacacgttcagcagactgatttttttaaaaacccataaaaacatattgcccattctataaagattcagtagtatgctgtcttcctaatatgtattctgagattatggttctgcctgtactattaaattataaagtaagtaatgactcacaagttggaaagctgaaattgaccaataaccacaaaatgatttaaagatatcacttttttatatttcaaagaaatcagtaattcctgtgctaattaaactgtttcacagcataaagaaaaaactgaattttttccgaagcaagtgtaaatagttatccttttattatagaatgcaaaacctgacaaagatagcgcagtaaaaggatgccttgaaaaactgatgatgtaatttattcaagacaataaaggtataaaaagatctggtaaaagtctggaaaaaataacaatgaaaagtctaatggagtgtgaataattatcccagatattaaaacataaaactatagagattaaaacaatgtgggctttggcctcactacacaaattagttaaaaagaaaaagaatacagaaatagattcaaatatatgtggtaatttagtgccataataaagaatataaaataaatgaaggaaggatgacttttcaatagtagtatagggagagttggctggaagctgttcaaaaaatatgaattcaaccattcctctttatattaatttttaagttccagatagataaaatagtgtactataaaaaggcatacataaatacataagatcgaaatatgagtaaacatttttacaaacttgtaatagggaggacccacaaagaaaaagactaatcgctggtgactgcaacactgacacataaattctataaccaaacctcagtgaaagactaaatcaaactagcaaattatttatatcacttagaataagtatccctaacataaagagtcctgattaactaattttcttaatgtgctaataggaaactaggcaaaggaagtgaatgggcaattatacatacatacatacatacatacatcccaaagaaagaaataggaatggcctatatgaacatgaaaatatattcaatcttgctaataattaaggaaatgcaagttatgactatactgaattatcatttatgatttattagataaagatgaaacaaatcataatatcatctgttggcagtatctgaagaaatgggcatgctcatgcgttgttggagggagtggggcaatttttaatcaaaattggaaggtactttatctagcaacccctcttaggaattaaagatatttgaagaagtattcaagggtattgatttcagctttttcgatcctaatgaaaattgaaatattttaaatgttaatcggaaggagatacagttgatctatgcagacatacaaagcttaaatgcttagagggatcatggagctagttaaatgaaggagtggttcaggtggaagacaatagggagtgatgggatcatagagaatgggagagtgtcctcacaaagggacaggcactctcggctccagctatttgtcaccatcagggaatgctgagcccaggctgccagatttttgtggaagagaagttgaaaatcgaaatttgagaatgcagtccccggatttttaaactaaaatgtaaaagaaaacacagtgcggatcataaccaacactttcgccaactctggatgtcataaatttgtttcttctttgtttatctaataggtcataagtgatcattcatgttagtcgtaacttgcatttctttaaaattattagcaacattaaatatattctcgtataggtcatccttattttttttttttgagacagggtctcactctgttaccaggctggagtgcaatggtgtggtctcagctcactgcaacctcccgtcttcccgggttcaagcaattctcctgcctcagcctcccgagtagctgggactataggcatgcaccaccacgcccagctaatttttgtatttttagcagagacggggttcaccatgttggccaggatggtctcaatctcttgacctcatgatctgcccaccttggcttcccaaagtgatgggattacaggcatgagccactatgcccggtccccttttatttctttgataggtaggtatgtatgtatgcatgtgaattgtctattcacttccttttcctagtttcctattgacaaatttactttaaaattaattaatcaaataccaaatttagctttcaaaatccagtttgcaccatgtgatttgtgcagtgaaagacttccaggccatcattgtggcaggctgttctgctgcccccacgtgggctgtcccatctccaagacaggattgtctaccccatgctctactgtgtgcctggcagtgctactgtgtgcctggcagtgctgctgtatgagcagtgcactggcccagcccgttaatgtggggccaagcatgtgtctccttttggccaaacacatacgagtggaggtgacacacaccttgtctaggagaccttaaggccataacaggtctccactccactgttccacactctgcatctgtcctaaacagggaccacctgaatcctggaatgagatggcacatgaagcagaaccgtaatgaatgacgaacccctgatatgttgtgtagttataagtcaccaaaactgttgggttcatttttgtagcaaagctgactaatttttaaaattgtttaaaatatggcagttttcactgacatgaaaagatctctacactatatggctgagtggaggaaaacagcagcaaaacagaatacataatatgaaactttttttgtttctttacttttttcttctccttttttttcttttttttttattatactttaagttctagggtacatgtgcacaatgtgcaggtttgttacacatgtatacatgtgccatgttggtgtgctgcacccattaactcgtcatttacattaggtatatctcctaatgctatccttcccccatcccccaccccacgacaggccctggtgtgtgatgttcccattcctgtgtccaggtgttctcattgttcaattcccatctatggtgttctcattgttcaattcccatctatgagtgagaacatgcggtgtttggttttttgtccttgcgatagtttgctgagaatgatggtttccagcttcatccatgtccctatttttttgttgttgttgttgtttttgagacggagtttcgctcttattgcccagactggaaggcaatggcatgatctcggctcaccgcaacctccacctcccaggttcaagcgattctcctgcctcagcctaccgagcagctgggattacaggcatgtgccaccacgccctgctaattttgtatttttagtagagatggggttcctccatgttggccaggctggtctcaaactcccaacctcaggtgatctgcccacctcagcctcccaaagtgccgggattacaggcctgaaccactgtgccaggcccattatatgaaatttttaagtaaaatgttgcatattaatatacctccatatagctatatgtatttttaaaaaagcctgttagatatgcagaattggtaatagtgattgtcttgagacgctggacttgggacagcttttactgtagtttttccactttcctgtattcttgatttcctgtaacaaatcatctttgtaaaaagaaattaatatttctacatgactgatggttaaaagaatctcaagagccatatagaacataaaatgattccaccagaataatttttcaccctcaaaaaagtaaatatcttcatctcataaaaacttgattatagagccaagactagccaaggcactcctgaaaatgaagatcaaagagaaaagatttgcttatcaggatttcaggaattattataaagctatactaattaagacaatatgctactggcataatacaagtatgtgaaccaattttaaaaagtggagagtctacacatatccagaaacttgattcatgacatagttggcattgtagacaagttggaaagaaacagagtttccaataaattgtgctggaaaactggttgtccatatttttttataaaaagataaattgggcccatacctcctattataactcaaaaattaatgcctcttggcttaaaattttaatatgaaaggtaatatcataaaacatttagaagacagtctacaaaagatcttaatgactttaaaggaagagaaagatttctttaatataaatctcaaacgatgaaaaaattaattcagctacattgaagttgagaacttctgttcatcaaaagatttcatttaaaaaaattagaagataagctacaaaacaggagataatatttttaaaacctgcaaaaggcaaaaaataatatgtagttatttttcagtgcttatgatgtgccagatgcttatactaaggctttacatgtattaatgcagctaatttcacaacaaccccatgagacaagtagtattgtcatccccattttgtagatagcactgaggcacaaagaagttagggaacttgctcatgcccacgtagttaggaagtagcagagctggaatttgaacccaggctgacttgctttgaagtctgttattttaatcactccaacatgacgttatactgcctcagctatattaaaggatgataattcaaaatatatgaagagcacctataatcaataataaaaaagactagcagtacagtgcaaaaagggcaaaagattaaagggtcattttacggaagaagaaaaataaatgatcagtaaatatgtgaatagtagtcaatttcactagtaatcagtgaaatgcaaattatagctactttacatccacctgattctacaatgtagaagagtccacatccttgccagcatgaaataatggtatagaggagttcatatccttgccagtgtgaaatagtggcacagatatggactcttctacactgctggagggagcatagattgacaaatatattaatgtcatcattctcttaagagttaattaattgatattttggtcctactatgtaaaaattttatggaaaaagtcatctctttaggtcacatttttctcccacatggacacatgagacagttctattaaaaatagaagcaaatatgtctcaattgataaaatatgtatatggagtttattaagtggtttgtaaaatataaaattcatctttaaaacttgaagggaagtatgagcctcactcaagtctattttgattaaaaagatagtacatatttgagtgaaaaaaattctttaacttattcttaagggcctatttaagacagatttttatcccaacttggaggcgttgacaaaccaaaatggtaactgttaattgatggcaggtttttaggcagtgggttttttgttttttgtttttgtttttgttgcacttaatatggtgccctttgtctcatttctcactgtcccttttatgcttttgtcttaaaatattaaatcagcaaggaaagtgtcagaagattacagtttagttcattgcaaaccacagcttatctttacactgacctgcagaacagtcttagtgatgttattagaaaaacaccagagaggaacagaactgagaagaaaaaaaaaaaaaaaaaaaaagctttgcttttctagaacagtttctaacagtgctaaaaaacatcatgttttgaactatcattttttgactcggtaatcatgatagcgagcaaatgccctctatcccctcagttcagtcctacagaattaagtcctggaaacagcggctgtccagtttgttaaagattgacctaggaaagatctcaatgctaccagcaccttatagggcgcaaaatgtaataatagggtaaattatgttttctttttcacatttgcacgctgagattgttttggagatcttttaacttagctcgttataatcaagttgtacagcctttgttttaataagattctaatcctgaggtctatccttcgcatcaatgactttacactgttaattgctttcttgtcctccattaaattgcggttgcagttgcttcatcttaaaaggcgccttgtgctttgtattctgccccatgctctgcagacacacttagtaacatcatcttcctaaagaacaaaattacctattatccctttaatcttgatgtacttttttatgtgtttggttcctagctagtgtccaaccaggaagctacatattatcttcttttaaaaaaaaatgtttttttaaaagccgcatagtgtggatggccaaaatttatttctcaatagaactcacatagtgcattcatttattttttataggactaattaaaaagacaaagggatctattctccccttgatacaccagagtgacttccattaacattaatggaagggaaatacttgcatggagatgagtggagacctcatattagaaagtgaaaacagcagagtctggagtgaatgtccccacgtttttgatgagagaagctacacaaaaagcaaatagctcaattcacaaatgtgttttccccctatgctttctgtttgtttgtatattgaggaaaatcagcgaatatttggaggcagttccttccttcagaaatcaattggatgtgaatttgtaattttaacacgaatgacacaacttacaggaggaactcagcaatgagaagcaacggggggatctgacaggtctttgctgcagtggagtcctgtgagacctgcttctggaggcagaggtgagagtagaaattggatacctgaagaactctgtacacagaaacttaattttcaaggaagcccagctgtccgtgtcaagctgatcttttgacacatctttccagaaatctatcaaaatctggagactgcttctgacttttcagtgtagcctctgaatctgtgatcctcttggcccccttgtataccttatgaaagttttaaattttaaatgtacataatctgacacacactggggaagtttctcttttatcatgtcattcttaggttaattaccagggaattaattatttaaagtgtgactagctctccatgctgtatattgttttaaaatattgatacattcattttgcatctggtgggtgctaagttcaaactgctttttaccctttgaaaatgtacttcaaaaatacaagcagtcttctgagtaacaaacctctccgtggtatcttgccactgccctccatttccctggcctggactttgctttagctgcttaaatcaggctcaggagcattatattttgcctccagtctctccctccccctgtctggttagcactatctctggaattttgttactattcatactgacctggaaaatgcttctaagatactttcttactttaattgcttcctttcttaactatgacaaactccctgcttcagaaccttacctggaactttctttggagctaaaagagattcaaatcctttagccagagttctttgttcagcttaaagtgtgactttccctgtcttatatttatcacctttaataccttctcctgtcttgggatccaattcagccttcatctgctctcgtcagaatttcctaaagaatcatctatatttttcttctcacagtaaaaccacattttcctccatacttcctatgttgtgaagtggtttgcaaaatgtatccagaggaacttgggctggaggagaaggagaaggcagtggcaaggagatcccataagcatttcattttaactttgcattttaaaaatcctttcattcccctaagattttttagtgcgttagttcaggacctctgagaagctgacaccaagacgaggtgaaatgtgcaagagctttactgggggacatgcctatgaagggtacagggaggaagcatgagtaagtaaggacggcctcagaccaagaggtaagtctggcacctgtgggaggcagtgtggggaaggctaaaggaaggaacaatgattgggtagcatggtgcagttctaagaaagttttgaaaagaccaatggaaagtcctcaagccaatcacctgccagcaaagtttcacatcaggcaggaatggaccctgtaccactactcccaccaggctcagcattggttggctgggaccatcctggaagaatttggcagcaccgcacatggtgctggatccagaggggtggcatttggggttttgagtcaactgtgctcccctccacaggaaatctgactagcacctttttaggccaccactctcagctgtttgttttcctcctgcagtgtggctgttgccctcagaagagatcagcaacctgtcaagacagtcttactcctactggccattctcccagggccaactaatgctgctttggcagtcaccatgggatcactatagacagtgtggatttccccctcacaagctctgagattaatgacacctgtacatccatgaaattagctccaagactatactgtagccaaggctcaaaatctatttcctattccccatttcaaattatatatagtcatgtttctaaaagacagcataacaggttgtagagatcaaacaacctgattaagatatttaatcgactgtcaacataaagatgccctaagtttgaatacaaactccctaccattttcaaattcctggagagaaatttaagtccaaatattcaatcactttacaaattaaagtccaaagaacataaagtctgcaatcagattctcttatcctagtgagctaaattttaaaaatatatatccacagtttattctctccaatttttgatattgctcagtgccaggtactggggttattgatacataagacgagttaggattgcttgaacagcttcagcctggagtttctatcactcggatggatgtagtcccttcagtgcttcataaattacagctgaagtctgaaagagttcaaaataaatccttaaaaatctcaagattattattggcctggcacttacccaaacgagaaagtgagctagtccccagctactaaagtaattagtctagtgcccagggttactaaaactgtagcagagattgagtgctaagtgagtaaaggagagtagttggagaaaatattggttttagtctttttttcctttgaagacagggtcctactctgtcacccaggatagagtacagtggtgcaatcatggctcactgcaacctcaacctgccaggctcaagcgatcctcgtacctcagcctcccgagtagctgggaccatatgcctataccaccacacccagctaattttttttttttttttaagttttgtagaggcagggtcttcctatgttgcccaggttggtcttgaactcctgggctcaagtgatccacccacctcggcctcccaaagtactgggactacaggcgtgagccactgtgcctggctggttttagtcttccaacaattccagtcaggctatatctgatgcccagaatctatgacctgtgaatataaattcaacggaaagaaatctttccataagaggttaactagaccctatacatttgtatttatgggaaaaagtcatccgtgtaaatggtcaactccagtaaatgttcttgaaaatggtctactccagtaaatgttcttaacctggttattcccctttcaaagcactcatctggaggccaagaatcacatctgtcatgagcaccatggaatccctggcatccagccccatgcctaacataaaggagggacttgataaataattgtttttatgaaaagaacttaagagaagttaattcctcctcatgtcattcaagcttctatatcagcttagttgaagaatagcctggtttatagggtgaactgttaaaactcttttaaaatttacaactgtgcaatgcagggttttcttaatactatgtaacaataacaaaaaaataaatcaagctctgagactagcataactgtgactaacttccataagctttgatttccaaattctatgttaatcactatacccacattattctcattgattgactttacaacaagtaaatatttactgttatgactgtgttttaaaaattataattataacttatatttaccctaataaaataatacatttaacatgcatgattttgttttaaagctaggtttctgctaataaagtttgaaaactactggcttggcgaaagtaaaattggctttgagggtgagaatttgatctggattcagatttctctctgccttaacatattttagactcaggtaactattttgtaaaatgggaatgattatatatacctcaaaatttgtttcaggattgagaaagttcagtaagaaaatcttaaaaggccctggcacagagcaggctctgtgtcttgttttcctcctctcttaacaaatgcctttattcaaaacaatcacagtagattatacaggcctacagacaaaataggcatttagtaaatctgctgattaatttcatttttcaatatttgaagatattttcattaaacaattttaactgtaagtgggttaaacagttttcattattagaattgactactttcttcaaagttttcgtattactttattcatacctgggttccagtacatgcctccccctagaatttcagcacctagagtacaggattatatcctagacttcatctttacagtgaaggccatataattgaacttcgtaaattttgaacaaatactttttttaaaaaaaaatcagaaacctatatataaaactacttatgtaccagcgctttgtaaatattaattcacttaatctttataatcccctgaggttggtacaggttatccgaaatgcttcaatgagcatttcctttaaatatgatgtttgagtgtcaactcagtgctgaaagagttttagattttgaagcattttggattttgaattttcagattagggatgctcaacctgtactgttattatccccatttcctagatgaggaatttgaggtctagaaagtccaagtgacctggccacagttacacgtcttctaagtggtagagtccagcttggagctcatcattgctttgctttaatgtccattctcttgatccttgtaccattctgcctcccattaatgacaatgcttatcatcatcaaaaaggaagctgcggtagcaagctgatgagattggtaataatttagctccagaatttttgtattacagtttctatggtaaccttaactcttccctttcggtatgtgctcattcatacagttgagctcagttagttgcaggtgctattttgctatttcgtctcacaggactactttatccatcaagcactatgagcaaaaggccatgggccttatgaacatgtttgagaatgaaaacaaagtttttactccaaaataagaaagctgcaaaattaaaattaagaaatcccttaatttaatagctacaacatgtaatataatgcccacattattgttaaatgtagttttcatacacatttcaatacacttgcagtctgtaggtttaattgctcacttcattagaattcccaagtaagcaggatcattgcagaataatcataaccagtcatacattatataagatacttatagcaaatattttaaaataaaattataaaaaaattttaaaatattttataataaaatgttatatttaatgtgagtaccttttactctgacatgacatgtagaggatctgatgaaggtcttaaaggccttgttaggacttacttcattttaatccttgacaaactaaccagcaagctgcctacctacttctctgtacacactagctatactgaataaggcaaagaagaaagcatacaccgtcttattgatgagttttataagtaatccactttttaaaagtaatagctatttttcctatccattaccatgcaaattcctgaattatttctaattctcatttttctgatttggtcattttgagatctacttcctacaagaaacagcagagaacagaaaatgtagattccgtgaacacataagacctctcagaacccttcggctgcttgcttgattttgaatattccatgactccttctctgcatggagtacaattctgagcttttaggaggccctagcaaattaccacgacctaggcagctttaaacataacacaaatgtattaccttacagttctggaggtcggaagtctaaaatggatctgcaaagcttcatttttttttctgggggctctgggaaagaatctgtttccttgcctttttccagcttttcgaggctgcctgcattccttagttcatgcccaccttcctgcatcttcaaaactagcaggatctggttggtggatttctcaccctgcacccctctgacctcctcttctgcctccctcttcccctttgaagaatgcttatgatgacattggtcccacccaggttgtccaggataatctctccatctgaaggtccttcgtttaatcacttctgtaaagtccctgttgccatgtagaattccaaggcttagtacatgtgcatccttgaggggccattattttgcctgccacagaggcacaaggcaaaatctagaagaacagatttctcagggcacctaagctgctgcccagcacacactgttagttattctcagaggtatattcggttcatctcactctgctcctgctactggttccctaatgcaccttacattctgcttctaaagttgctgctgcctctcttcctactcattacttttttcttaaacctaataacatggaatatatgattcactacctccctttgattctgttggtaataatgccctgtgcagtagacccttggtgggcagagcagtgtatgtaggcacatgtgcacgtcatgcctgcacacccccatcatttttatttcccatctttacctctgggttttcactactgtttattcagaaaatatacatatattctttagagaattgccacatgcaaggaattcattcaagactttgtgtgaaataataatgtacacagctgtagtgaacttgttttctctctccccctaggcgcaatccccctccccttcctcttcatgcccagtcagttaaaggtaccagaagcaacagtggcgtagacttgtcagactcagacctgccacttagcagctgtgatatcctcctccgcatattccttaatctctgtatgcgtcagtttctttatagattaaatgcaaatagtggcagcttttccacttcagactgcgctcaggaatcagtatttcatttgatttttaaactgccatcaaggctaagacaaagcccttatgagataaaggccaaactcctcaggatagctctacagggctcttccaaatcagatcccatcctgaccttccagcttcaccttccattgcttctactgcatctcaccctccccaaaccagatctgcttgccaggcgccagacatactgaagacaggacatgacttcaggttagcttcatggttttttttcttttttccactttgataatgttaaaaaaaaaaaaaaaaaaaaaaaagacgaagtgaggtgggaggacaaatgccagccagtgttagagagagattttctagaactcccaaggagaattatcatgccttgagaaaggggaggacatatactgaatatgtttaaatttagattaaatgtatgtttccttttacaacatacagttaatcagagataactttgtagcgatcagtgattcctagccagaaggctaggaatttggcattattaaatcttatcttccctaaataaagtaaatgggatacccacaaataactgagtcctcattttactcaatgggcattagaagtaactaaataaattgaaagttggctgttactgaggatgttgcaacctgatttggggaggagtggaggaggagaagaccatgagaactctcacctctggacagggcttggcactccggaagagttccactttttatgcacctgatcccttagcaccactaggtggtaagaaagcaactgaaaccaacctgagaagggccattgacattacatcctccccaagtcacctccatatggaggaagaatgactagacccacaggagtgaaagccacaaggtcagaggaaaggggctgctgctaccacattctcagctgcactcttggtcttgataccctttacatagacctcttttacttcttaaatgctgtgtcaagggcactcaatttgactattctgagtggatgaatttttaataagtggtgtttgtcaacacctgtctccccatcggggagaagccttctgggacccaggccatgccctgtcaccctgtcacacctcctgaccactatacatgctgctccagtaactgagccaccccccaccctccttacatgctcatcaggcagtccgtgctcagcagcccatctgtgaagcatttcctagccggctgccacacccaacacaagcaaggaaaggccattcattaatattttatgctaacctttaatgcactatacaggatatatatgtgtgtagaacagaattttcctacagacttctcatgaaaacatttcactcactgggctgggctggtcaccatagaaatcaagttaaatgactacagtgcctgcctgttagaggcatttgaatgtacaccatagcagggacaggggcacacaaagaaatgagagtaaccctctgagaaaaatcctaacttctcatcccgcctgccaatatttttttcctataagatagtaaataactacagcaaaacttctactaaaatgcatgactgacatttcgttttttgctttctagtttgcaagttgttttcatgttcgttatctcagtggatcttggcaacaacccagtgtaaaactcgttgtatttttcattatttatttatttatttattttggaaacagagtctcactttgtcgcccaggctggagtgcaatagtgcgatcttagctccctgcaacctccgcctcccaggttctaacgattctcatggctcagcctttgctgggactacaggcaggcaccaccgtgctcagctaattttttgtatttatagtagatagagggctctgccatgttgcccaggctgttctcaaactcctgagctcaggcaatccaactgcctcagcctcccaaagtgctaggattacagacatgagccaccacgcccggcctaaaacctattttatttatttatttatttattttcaagatggagtttcactcttgttgcccaggctggagggcaatggtgcaatcttggctcactgcaacctccacctcctgtgttcaagcgattctcctgcctcagcctcccgagcagctgggattacaggtgcccaccaccatgcccagctaattttttgtatttttagtaaagataggatttcaccatgttggacaggctggtcccgaactcctcaggtggtccacccacctcagcttcccaaagtgctgggattaaagccgtgagccaccgtgcctggctaaaacccattttatagatcatgaaattgaggcccgatttcatcagttgaggcaattgacttatctaaagttacagagccggtgggcgtggcagtcaggagagaagagtgtggtcatccatctattcatcctccaccaagcccttagcaggcagctgccatgggaagagcacaaggaagagcacaagggagatgctgataaatgaactccactttctcccctcaagccgctgctgccttgcttttcccatgcaccatcccgtgtttctccccgttcctccttgtttcatctgcctattatttcagtaactcattctgtgctcaaaggaagcccccgtatggtgtgcttcctttatgtactatgtttctcaccactacaccatgcgctaacacaagactattcaatgattgaatctcaggcttgtgacttaaacagtttcccacacattgggacatcgggaagcatttggggggaagaactacaggagacagggcagcctagttctagaagtcatcatcaataatgaagatacaacaaggccaccaaagcaagggggaaatccagggaaattttacaaacaaatgataaaccattgattgttgattataggaaaagctcacagaaatcaattaaggaaattaacatatccatacaatgaagggacaaaatatacaaaggagcacttgataaacaaactaatgactaataaaaatgactgtagtctaactagtagtcaataaagtagatattaaaacaataatcttcacctgtcaaattagtgaaatacatatatatatatatatttgtgtgtgtgtgtgtgtgtgtgtgcatatgatgaaacaggcacattttaaaaatactgctggtggaagaacagtgtgataggtctttcagtaaaagtaactggagctatgtatcaagagcttcaaaagagttcatattcaggttcagtaatttcatttttaggaatctaccttaaggaaataattagaaatttggtcaaatactcaaaacagaaatgctcaacacaacatgatttataaaagtagaaaattgacagcttagatgaatggtaaaaaaaaaaaattccatgaattatcacaaagctctgtgctgtatcataataatgcaaagaatatttaaggatgtcacaaaatgtcaaccacaattaattctcctgaaatcttggaagaatgtcatcactcttcatatggtagaaatggtgggtgacaaggggcttcctccacacaaggcagggagggagcatggggctgaggaccagacctggctgccaccacttactaaccgtgtggccatggcaaagttgctagactgcccagagctcccaattccccacagtgtcccttacacctaccttagcagacaaattgtgagataatgtgtatgaaaacgttgatgtggtaaagaagctagggcagctgctgctggtagcatagaatgcaggcactggagagaaaaaactattagtgggatggataacaggctgcaaaagtactttatgaactaaattgcagtatgtgtctaaagtaatattttaactgattacaaattttcattctttttcacatacagaacattcatatccccagctgccctcagtatcttaaacattccaattgcctaattattcagatgtcctccaccaacacagtcctgagtcctttgatcatccccatccacaccagcccccaaaggtggctccaaaaatcacccagacccctgcagggtagccctatgtcaaaggactagctctagggccagaagacctgattcaaagcccagttttgtcacatgccagttgcaaaccccaagccaaagtgcttaactactgtaaagccacagtttcctcaactataaaatggggatagcagcttctacctcatagggatggtgagcttttatttggattatttcatttaatcatctgtgcaatacctggcagagaggaaacagtacatggtaggttttattactactactgcctctaactcatagatggctttcagcttccagttacacaatgctgttcctcccagcactgctcacatgttctagttaaggacaatagaagcagcctccagagtgtaggacaatgtcagcctgtgcagaaagcatagatggagtcacaatgcgtggcccacagcctttggggctatccagactgctcatggatgcccccaaactgtgactggggacatctcaacctaccctgatgtaggttttgggaataggtacaaattgaacatgtggttagcatttgtaacacttcatgaagatattgggaggggtgggtgatatgacctagccctgtgtccccacccaaatttcatcttgaattgtaacacaaattctaatccccacgttttgggggagggacctcatgggaggtgattagatcatggggtagttcccccatgctgttctcatgatagtaagtgagttctcaggagatctgatggttttataaggggttttccctgcttcacttggcacttctctctcctgccaccatgtgaagaagaacgtgtttgcttccccttccaccatgattgtaagtttcttgaagcctccccagccatgtagaactgtgagtcaattaaacctcttttctttgtaatttacccaatctcagatatttcttcatagtggtgtgaaaatgacctaatacaggtggtatatcagggaagacaaaagtcactggggaaggataggatagagaggaagaaatctggtgttgtctattacacctgtggaaatgataggattctgaggtcatgttgaccaaagagcagggatttgggggtatggaataggccaccaattgagtcaaggcagatggagactggtttatgccacatgcgtacccagcttgagtggtcctgccctgagcagtgagcaagtgaccagcaaggacttccaggtgcctggtgtatttctgctggtgaggcagtcccagacctttccttcctgtcacttcattgcctttcagcttatctggacacctacttggtacttccccatgctgaaggctacatcatagtcatcactgtttcttacggttgactggtggagacctttccattttatgtttcttttcccgattgttcaactgttaggaagtgagataagggaaatgagtatgggctttgcagtcagaagaggattcacacttctactgtgccccttcctagttctgtgtccttggcaaagttgtttaatttctctaagcctccatttctaaactatttgtaacaaaaatataaaaatatgacatcacactccactgttgtaaaaatttattgagaaagaaaagtatttggaaaaaaactagaatacaatatatggttagtaagtgatactgtttttctctttggacaaaaaacatttaagagaattactgaaatattattcttgtggcattacgaatatctagtcaaatatgtttgtaaatgtcttgatgatcaaaaatatttgacagttatggctgggtgcggtggctcacacctgtaatcccagcactttgggaggccgaggcaggcggatcacgaagtcaggagatgaagatcatcctggcgaacactgtgaaagcccgtctctactaaaaatacaaaaaaattagccaggcgtggtggcgggcgcctgtagtcccagctactcgggaggctgaggcaggagaatggcatgaacctggggggcggagcttgcagtgagcggagatcgcgccactgcactccagcctaggcaacagagcgagactccatctcaaaaaaaaaaaaaattttttttgacagttacaatgaagccaagtgctaaggatataatgattaaataagacaaagttcttgtcagttggaactttgattctagttgggaaagacatcagataattaacatacataggtatatataaatatatgtattggtatatatatagataagatgcataaactaatgtatgtatagaaaaataatatatccatatgtgcttagctgtgcacttttaaatgaacatcttgccttttgattgattatcttagctggtgataaggacatgtgaatgaaatcccagactccaaagtatcaggttctaaagagattagagtgaggaggtagattttgagctaagaaggatcatgcgttaatgtctaagaatatgcatgctataaattgtgacacctctgaaagtgaagtcagctggctttcctaggccagcaaattgctggtgaccctggagaattgtataaggccacaatttaattgcacaggctttaagagatctgcactcctttatcccattaattcaacctgcaactttgttctctggtcccttttgaatattcagttctcattgatttcaatgggagttacagactcagagaaagggaagaattgggccagtgatctgttcaaagcaaagcatcatttaaagtatagttttaaagtatttgcaggcacataggtgagtcagctccttctcacgaatttgtctagaatgctttccagtttaaatggaccatcttaaagggcagtcaccttccctaaaattgcagcatcatactcatgcaccacatattggattgtgactgctgggaggcaatgactccatgttgtggtctcaactttactgcggaattgcttcagatttaagctatagcctaatcgtaattagcagcccaaagtaacattataaattcctacaatgcctattgggctctgtctgctgttccacacatcaagtcaagtcaatatagccttgccctcagagaccttttgtttgaaatagtctcggtctattggtcatgcaccaacacagaggcaaagaagcaaaatggctgtaaatacaacgcttaaagcaagtgaacttgcacagacagggaacatggtgctatgatttcagctctccctcgcctcatggactatataggttatagcacttggctgcacgataaatttctgtaaagcacatcctatttttgtactcatttccattgtgtaatcccacgtgcattagaattcatgaaagtcttatttgaatatttctttaggagagagatcccgacagtgtagactgccagacatccaactccccaactactctgtgtctgtccagacttctcagtgctgatacaagctgcagccttgggagctcagggccttctgtttactgggagctctttctctgaccaagagaaagttatctgtatcccactttgagatacccagaatccgtgcttccaacacctccctgttccttctgtctgggtatttatattgcttaggaggaccaggctcaggactggccccctgtcaggaactgcctctaggcgtggcgcaaaaaattaagttcccagttttcacttttgcaatacaagtgaagagagctgctatatacagccttacaggtcgtacagtccaaatcagaaatgtggcgacactgccaatgctgaaccttgtcagcgctttgagatggcgtctaactctgactgccactttagtggctgtgctaccttgggcactctctggatcctgactttctccctctctaaaacggggccggctgggagcggtggctcgcgcctgtaatcccagcgctttgggaggctgaggtggatcacgaggtcaggagatcgagaccatcctggctaacacagtgaaaccccgtctctgtgttgtaaaaatacaaaaaattagccgggcatggcggcgggcacctgtagttccagctactcgggaggctgaggcaggagaatggcgtgaacccaggaggcagagcttgcagtgagctgagatcgcaccgctgcactccagcctgggcaacagagcaagactctgtctcaaaaaaaaaaaaaaaagaaaaaaaaaacggggccatgatattcaccttttagagtgatcatgtggactacattagacaaagcgagcaaaacgtctgctcactatgtagtggtttttggttttttgtttgtgttgttttcaacgagagaggttatttaaatggataacatccttaccatggagtaaaagctcatatgtgattaatattttgaaggaaaaattcttgtttacttttctcagatattgaagatattcatgctaaccacattttgttcataataatgctccaaggaaaattttctgcagggcttgattcttactacagtatttcaggccggctcagcactccctcacctggtattttccatgtaaacaagtaacaaaataaataggggcaacaaaagtcactgctattgtaattattaacaagtattctttggttgattggcttttcttatgtaaaattctgtttctaataattgttaaaatagtaaataagaggtcccagaaataagatttgtatcatgtttaaactccatttcaaaatgtttattgccttgctgcaaaataaaaaaaaatctcagatttgtgtgatgtgtcctagcttacagcaatctattttttagtgtctttttttttttttttttttttaagaccaagtcttgctctgtagcccaggctggagtgtattacacgatctcagctcaccgcaacctccgcctcccaggttcaagaggttctcttgcctcagccccccgagtaactgggattacaagcgtgcaccactgtagctggctaattgttttgtatttgtagtagagacggggtttcaccatgttggccgggctggtcttgaactcctgaccaaaggtaatccgcccaccttggcctcgcaaagtcctaggattacaggcatgagccaccgcgtccggcctttttagcgtcttttctttgccttctaagtagttgtacagatctagaagtagtgctagctacattacttgtggaatataaggttaagaaattcccaggaaaagtttaaataatttcaaggcaattatttcagtaactttaaagaaataattagaatttttagaattcaccaataagtgtttatatagtagagatgtagtggggttagggatttgggaatggcaaaaggggataaaacacacagccagaacctcttcagtggtaactgctaaaacagcaataaacaacaaaaccaccagtggtcaaattgtgtagtatgggctttaggtgctaaagaagttcagaaggagagaaattttagtgtagtctttgataatcagagaagtttgctggtgaagctgggtcttgatctaggtctgaagggatgaacagaatttggataggcagaggtaataactgttccttagtgtttaataccgctgatctgcagtgggaatctgcaaattctttcacattataaggatgtaaaatatttccaaataactagcaaacctaagaacttgactgtgaatgcctaagatgattcagcaataaaacttctagacataaataaaacccatctcaaagccctgactcagcaataaaacttcgcagacataaccccataggaagaagaaataccaccactgaggtccacagttccagttgggaaccagcattgccctgagtttgtgcatcagatcttcaaaagataaggggtcaacagattgtgattatgcaaaagaggtgttccaattctactgattgtgattatgcaaaagaggtgttccaattctacttgggcacacaagtaagtaagttaacaagagaacctgaaagttagctaaattggaaagctggctgaaatgctaaataaaacatactcagtaagaaacggcgtgttcactcagcccggaggaagtgcagcagaatggagaatgttttctaatacagctctactcattataatctcagctcagagctcctcagtgataggtacagaaggcatattggaaacttcccacatgtctatttcctactaagtctatcatcaaaaactgcaaaatttaaaaatcacagtgaatgttgactggttttcttcagataaaatgatgatgaaggtattaacattctgtgctatagatgccatactgaatgtgtatatataattaatattatgtatacatatatgtatacatatgtacatatgcatacacatatatatatagtcttagtccatgggctgttacaacaaaaacatcattgggtggcttaaacagcaaacatttatttctcacaattctggaggctgaggcttcgaagatcaaggtgctagaagatttggtgactggtgagggccttcttgctgattcatggatactgtcttctcactgtgttctcacgtggtggaaaggagtgagaaagctctctagaatctcttttataagggcacaaatcctattcatgagggctccaccctcacgacctaatcaccgccaaaaggcaccacctactaatatcatcacattgtgggctaagatttcaacacgtggatttgggggagacatattcactcaataaccctgtaaattgaaatttatagttgttttaagagtctgctcacctgcctgtgtaccccagtatcctcttctcattgaagtccagtctcatccttcctaacaactcaaaatctagactcatggacagcattcttgtcacattattccccactactccatgcccatgttatgttagactcgtggttttgtaaacaaacacattttgaactctctttattttcaccttcacggatatccagcaggtcactctaaactctgccttaccagtttattctgatcttatcaggcacgtgaagttgtggtaaaatgtgttctgtcctcacctctgtcatcattgctgctactcatggaactcagaccaggaaagccagagctagtacaaacacctccaaagaagtagcaaatgactggttgtgggcaagagtaacatgaagactgtaattctgagacactcacccattccctgccagggaataatataattgtttacctgtgttatagacacccagaatctaagagaggcacaagaatccatctagccagatctggcatgagactcatttgctaaaggtccccagggggaatttgtataagaagaggagcccaaaagtgcatggaatagatttaagctgtcccttgaaatgaccttgcctggttaaccaaaatctggattcatttttactgtgtcttttacaacaatcaccttcacagcattagacggaaccattaatgaaagcaggagctcttctagtcagtacacataaaaagaagtcgtttaaacccagtattacgtagatattaacactaaaattgcaaaaaacagtttttaagagaaagaagaagttaagaagtatcaaaatatcagcacttatttctataactaatgtatatatagaagacatttaaatggaaattatctgtgaactaaaatgagaagttagaaatagtacaataacagaaatggttattgaaatcatctgaaatttccttcccttctacagtatcaaataatgatatgacagtctaagttgctcacagaataagatagcattaggaagattttagaagacatttttggagtttcacgaaaggaggtccctgaagaatagaagatggtttagataatgctattatttaatcaaaaatgtcaaataccagcaatcacaccacctgcttttgaaagtaaaggaagctagggactaaaaggggtggtttaaaaagagacagaggaagaataaatgacaaaaagagaaaaaaataattatagatagtctaaaggatatggatataggttgtatttaagcagtgtttttttgtctcagaagtttatatgtgaactaaaatgtattaaaggataaaaaagcaatatgtacaactttttgtatgtcagtcatgcctctataaagcagttttcttaaaaagataaagaagaaaactctaggaattagcaccttttttaaaggatgagaaaagagagtccagttacaataactgttaaggttcttaaattcttttacacctcttacccccatatttctggttttcactgtatgatagtttgataatacagcccaaatttaccttttagctgtagctcttcttctttgttagggcttgattcttaaggagattgctcaggtgttgagaacaagtagtagagacacctaagtatacccagtattaatcccagaagaaataccatgttagtcactttcacttcatgcagtagctaatctttttttaaaattgtgttagcgtaaagtgttggtgaacccactcatttttacatgggattatcccaatttacataacctttttgtaacaccacattttcaagtgttggaaaataaaaacagattaacttaatattgtgactaatcgagagttaaccaaaaataattgtatttcaaacctatgactgaaaatgtttcttaaacattagtcagcttccctgccttagggattgttgactcacctccagttgtagggtgaaggatagctcagccattgagactgctgccagcctcgtcacccagggctgtaggtcaaggaggtgccagaccagggcctgaaactactctgaaccctgcccccacgttcactggttttcagcactaagatttgcttgaagtgaagaaattgtctagatgcgtatggacagtttgacattgtctgagtaagggaaaatatttttattttaatacttgtcttttaggaaaactatcatttgtcaacagggatctgtatgttttaataaagcagaggaagggtggtttgcatgtagtcacttagctaaaatttcatgtcatttaaattttctgatcatgagtaacccagaaaaattaaatatacttaagataaaataataaaatcctttcatatatataaataagcaaccaggatagttttcattctatctatctagctagctatttatttattatgttttaatttctttttttacagacaggtttttgctctgtcacccaggatagagtgcagtggtgcagtcataagctcactgcagcctcaaactctgggctcaagtgatcctctcaccttggactcccaaagtgttgggattacaggcatgaatcactgtactcagcctgggaagcgtgggatagttttcgttttcaaaagtcagttaagattatctttagcagaaatactccatcagtgctgacttttccaatctgacatatgtagtagcgtaagaacatgttttaaattttaaaaactaataagaaaataagtaaggcaagttcttcatataacaacaatgtatagaggaaagagcaatatgttaagaggagaagaaataaatttatttctatagaaacaaagacccagtgggatcaaaagaatttagaatttttaacacaaggaaaatacccatgcatggtgaggtagtagatggcttattctcttcctattcctaagatatcagtgttactttagcccaccgtaaaggaatatgaataatttccatgaatcaacgtaatgtatgcatctcaaaaagatttttaatttttaaaagattattctgtagtctcttacagtattttcttgtccaagccttagctgaaggattgcagtgtttctaatgatagtgaagtggctctaatgaggtggtctcctgatttaaattattgtatcaacatcttcatgtaacccagtaacaaaatatatgtacatacacatatatacacaaaacatgtatgtatatatgtatgtagtagatcaaaaattagaattctatttttcttaaattttactttaagttctgggacacaggtatagaatgtacaggtttattacatagatatacctgtgccatggtggtttgctgcacctattgacccatctctaagttccctcccttcgcgcccaacccctcacaacaggccctggtgtgtgttgttccccactttgtgtccatgtgttctcactgttcaactcccacttatgggtgggaacatgtgtcgtttggttttctgttcctgtgttagtttgctgaggatgatggcttccacctccatccatgtccctgcaaaggacatgatctcgtttttatggctgtgtagtattccatggtgtatatgtaccacattttctttatccggtctatcattaataggcatttgggttggttccatgactttgctgttgtaaatagtgccacaataaacatacatgtgcatgtgtctttatagtagaatgatatatattactttgggtatatacccagtaatgggattgttgggtcaaatggcatatctggttctagatccttgaggaatcgcctactgtcttccacaatggttgaactaatgtacattcccaccaacagtgtaaaagcgttcctgtttctccacagcctcaccagcatctattgtttcttgactttttaacaatcaccattctgactggtgtgaggtggtatctcattgtggttttgatttgcatttctttaatgatcagtgatgttgagcttttttcacatatttgttggctgtgcaaatgtcttcttttgagaagtgtttgttcatacactttgccacttttttatggggttgtttttttcttgtaaatttgcttaagttccttgtaaaatctggatattagacctttgtcagatgggtagattgcaaaacatttctcccattctgtaggttgactgttcaccctgatgatagtttcttttgctgtgcagaagctctttagtttaataagatcccatttgtcaattttggcttttgttacaattgcttttgacatttctgtcatgaagttttttcccatgcctatgacctgaatgttattgcctaggttttctagggtttttttaatggattggggttttacatttaactttttaatcattcttgaattaatttttgtataaggtgtaaggaaggggtcctgtttcagttttctgcatatggctaaccagtttttccagcaccatttattgaataggagagcctttccccattgcctgtttttgtcaggtttgtggcagatcagatggttgtagatgtgtggcgttatttctgaggtctctgttctgttctattggtctatatgtctattttggtaccagtaccatgctgttttgattactgtagccttgtaagatagtttgaagtcaggtagtctgatgcctccagcgttgttctttttgcttaggattgtcttggctctacagggtcttctttgattccatgtgaaatctaaagtagttttttctaattctgtgaaaatgtcaatggtagtttgatggaatagcgttggatctataaattactttgggcagtatggccattttcacgatattgattcttcctatccatgaacatggaatgtttttccatttgtttatgtcctctcttatttccttgagcagtggtttgtacttccccttgaagagatccctcacatcccttgttagctgtattcctaggtgtttgattctctttgtagcaattgtgaatgggagtacattcatgatttggccccctgcttgtctgttgttggtgtaaaggaatgcttgtgatttttgcacatttattttgtatgctgagactttgctgaagttgcttatcagtttaagacgttttggggctgagatgatggggctttctaaatataaaatcatgtcctctgcaaacagagacaattttacttcctctcttcctatttgaataccctttatttctttctcttgcctgattgccctggccagaacttccaatactatgttgcataagaatggtgagagagggcaaaatataaagaccaatgacactatgaagaaactgaatcaactagtgtgcaaaataaccagatagcatcaggatgacaggatcaggttcacacataacaatactaaccttaaatgtaaatgggctaaatgccccaattaaaagacacagactggtaaattggataaagagtcaagaaccatcagcgtgctgtattcaggagacccatctcatgtgcaaagacacacataggctcaaaataaagtcatgcaggaaaatttaccaagcacatggaaagaaagaaaaaaaaaagcaggggttgcaatcctagtatctgacgaaacagactttaaaccaacaatgatcaaaaaagacaaagaagggcattacataacggtagagggaacaattcaacaagaagagctaactattctaagtatacacgcacccaatacaggagcagccagattcataaaacaagctctcagaaacctataaagagacttagactcccacacaataatagtaggagattttaacacactttcaatattagacggatcaatgagacagaaaattagcaaggatattcaggacctgaattcagctctggatcatgtggacctaatagacatctacagaactctccaccccaaatcaacagaatatacattcttctcagtgccacatggcacttattctaaaattgaccacataattggaagtaaaacactcttcagaaaatgcaaaagaactaaaatcataacagtctctcagaccatagtgcaatcaaattagaactcaggattaagaaatccactcaaaactgcacaactacatggaaactaaacaacctgctcctgaatgactgctgggtaaataatgaaattaaggcagaaatcaagaagttctttgaaaccaatgagaacaaagagacatcataccagaatctctgagacacagctaaagtggtgttaacagagaaattcatagcactaaatgcccacatcagaaagctagaaagacctcaaatcggacaccctaatatcacaattaaaagagctagagaggcaagagcaaactaatccaaaagctagcaaaagacaagaaataactaagatcagagcagaattgaaggagatagagacacaaaaaaaaccctccaaaaaatcaatgaatctaggtgctggttttttgaaaaaattaacaaaatagatagaccataactaaaccaataaacaagaaaagagagaagaatctaatagacacaataaaaatgataaagggaatatcaccactgacctcacagacatacaaactaccatcagagaatactataaacacctctatgcaaataaactagaaaatctagaagaaatggataaattcctggacacatacaccttcccaagactaaaccaggaagaagttgaatccctgaatagaccaataacaagttctgaaattgaggcagtaattaatagcctaccaaccaaaaaaaagtctaggaccagaaggattcacagccaaattctaccagaggtacaaagagggtttcagaagataccattccttctgaaactattccaaacaatcgaaaaggagggactcttccctaactcattttatgaagccagcatcatcctgataccaaagtcagacagagacacaacaaaaaaagaaaaatttaggccaatatcactgatgaacatcgatgcaaaaatccttaataaaatactggcacaccaaatccagcagcacatcagaaaaggtatccaccacgatcaagtcagcttcatccctgggatgcaagctggttcaacatacacaaatcaataaatataatccatcacataaacagaactaaagacaaaaaccacatgattatctcaatagatgcagaaaaggcctttgataaaattcaacatcccttcatgttaaaagctctcaggtattgatggaacatatctcaaaatcatgagagctatttatgacaaatccacagccaatatcatattgaatgggcaaaacctggaagcattccctttgaaaactggtagaattctatttcattcaaaaatgattaataatgtttgaacatttgctaagaatactgtgattactgttgctttcagtaacttcctttgaattttcttcataataccaaaagattaaattttaaaaaaccattagaagagaacatgggagaatcttgctatgatctaagagtagggaagtcctttccaaacaccatataaacattaagatgatctttagcttcaactatatataaaagcaaaagtttgaagcttaataaataagcatgaaatgacaactagcaaataagagaaatatttgcaatacagtatattactgttaaatgcttctttatccaaaccttttcacagagatacaaacttgtaaatgtgtttgacaatattttattgacttgtcaagagaatcagtgcacagtgtaggtgttgggaatcgttttagtgctgttttcatgctatttgttaaaaaacctaaattttcatgttatgatttagcataatctctgagctcaaactgtgctctcaaaaccttagggacaggaagtagtatggttcaggaagaaccaaagtaatttcaaagccaaactagtcagtacttgaaaaagtctaatttttgtggtggtttccaatggagaaaatgaaaataatccctcttcagaatttggctctatggactgtttgggagactgaattgctcttttcccatttgttaaaccaggaaatttctaaggctccttccagctctccaattctctagtgctatgaatatcctcattattatcattacatctcattttgcttaaagaatgctaaatcagtagtctcgtatcttacatctatctttgtgagaaagagtaaagaaaactgagtttggtttctttatgattaatgcatttgtcaaatttgttccaagtagcaaattaatttattgtgttttttcatgaatgcaaattaaagctgtgcaaactattgtggtaaaacttagcagtccttttttataaattaaagctaactgatttaatgttaatgaaaggaactatattcaaacacagattttaataacttgggtggaaagaaaatcttagacttcataagcttttccttacataaaattcatgtaatttgaacagaaagtcattaaaatgtaattgtctatagtgaagcttgtattaattaccttgtatgaaaatctgaaaagttcctgaataaatgtctgtttctatgcattccctgaagagaagaattgtctattgattagttaattatctcaaaccaagggtcccaggttcagtttttggtgatcactttcttatctttttcctgtttgaatattctgatcaaaaccagaagtaaaacagattttttttaaatagagaagtattttgcttctgttcatattgataatacaaagagtaccagtatacatatgataaaatatttttcaacttcttggttcataggacttaatcagtgtttcatgtatctgtgtttgtgggtgtgaaaagcacctttattactgggaataagattttaagaatgattttagaaacatgtcctttaaatttgattctctcatacttttaagattatttaaattcacttcaatgtgattgtccaaaacaaagttattttcaaactcactgaatccttatgttcttctttagtgttcactattcacaaagcccattttgaatactgatcctgaaaaacatgagagaatcaaaatctgtgttttcttttgatttttgcatcataattgcatttttactcatttcaacaaggggaaatttcaactttttatattgactaaataaacaaagtgtaggggctaatttatgtttttaaaaaggaaaaatttatagatgctatgtttgattacacttatttcttaactggtatttaggaatttgtgtaataataaacacttctcatttttaacatcaaaatttgcaaggttcatcaaattctgaaggtaatgcctgattggagttaatgttcacttaattctgggtctaatcatttcagctgaaaaagagaaaactaaagcataaatcctttgactcatcctatcttatatttatgtcatattaaaagtcataaaaatggacaaaacaataaaatttaaactgaaacatatccaaaatgtttttggcttatctacctacaaaccagagacatgccaggtatgaaggaacccaaggctggagtaggtcagagggtccaatgagtttatccatcctccagacatggtcactttcagattgtactttaagaaaaaataacttcacggaggaccattataatttttgtgatgaacatgtgtaatatttttgcacccactttttagtttttatcttggctgccttaacatcttctttcaaaatgtcagcagtgattaggctacattatgggataattagtatgaacttttatctcaaagctaattttgactaatactagaacaaaacatatgtcaatatgttaaagatgggaagttgaacagattgctttcctatataaacatgtttttttctaagttcaccttactttttaaatactaatccaatctaaatgtttgaggaaggttaagcaacctgtgaaagaagcaccatttgaaatttgatggtgcagttcctaaaatctttccaaagaatgtggtatagatgcttacatattaaaatattgaccttctaggaagtttaggaaatatttcctctgaacttgaactctggggctgtagctatggttgataagctacacccaattcacactttaatgccggtgctttgtattttaacattatcttaatgtgacattgtatgccttgtttatttcttctaagcaggccttttcccaaattacttaaaattaccaaacaatgtgtttttaaccacagtcattctagagatttatttggtttttttccttccccagaagttgcttctgtcatgtttgattgcacatctgaatacagaccatgctcagagttgtagtgtaaacctcttcaggtcggatcataagcctcagaacgtgtcatacatcccataaacttcagaactagccatacacaagcttcagaactagtcatacatcccatgaagggcatcataactgatactgatctgaacagttcagtccaacagccaggcaattcagccacctacaattcaactattggttttatttgaatgaaaatcaaatttggggtataattggcttagctaaaatattcaactgggtcaattttggtcacatgagtgattctgcacaaagatatagccacattttatctcaggcatctcactcaacatttttaaagataacattttttaaaatctcgtacaaagactgcagtaaatatacaactaagagtcatactggtggatggtaaacatctgggcatgagcattatgagttaatgtgtttttgtacactgactttccatctttgcagattattctaactctctagaaataatgggtagccctttggcactgaggctcactggctcagggtcagtatttttacttctccatcttctctcagttagcacttgaacaaacaaagaaaaacaactggtctgctatttccaactcctgaaagtgaaatagggaaatagggacaaaatataattaattaaaatatgcagttattcatacaggatttgcttttgttctgataattaggatcccaatttgtcaaatgctttaaaaacatagtcttacagccttttactaagggagcgggaaggggtgaatatccaggttgattataagccatatatttgtcttttcaagatttgcttttacattgctttagggaaaatgataaatatatttgcaaataaaaattgtaatctgtatttctccaattttagtaatcccaaattactaaactaagtaatttaatttaggatttcggattaagagactacgaaactaaatctgattaaattatactttttgaaacctgatagtaccgtacttctgctgcactgcactttcttagatttaatgcctctaaagtataatgatattataagtttcttttctttatttaaaaataaaatgattactctaattatgggaactcatgtaccattgggctgaaagtcagagacagctggatggtgaactggccccttgcccagacctcagaggaagattaatttgaaaactctttacagaacacagcccagagcctactgctcagaagatcttgctttaatcagccattgatcatcagagattccctttattgacctgaaagcaagtttttttcatcttcatgccagctaaggcacttactgaaagtaagtagacagcatccaaagtgaatatgcctaacgaagaaaacaaagttttccatctctccccgcaaatgacattctgtaatgacatgtgctaatagtttctatctccatccatcccttaacccatcacgttgccatcctgtgaggaacctgtggttaacaaggggccccttctgcagatacacacgtcaaatgatctaggaaacatgtcggcagggattgtggaaccggtctatgagaattctctttgtatctgaaaaataccatggagtggatgcagggcagtgtttacccccctggatataacatcagaaaattccagatcactctgaagtctgttctctctctgatttacctgcctgtggagtttgaaaggtccccactagtgctgactctttctgacacttctcaatctatagtagcttggaggccactttgattgctcccaaaggcaaaatggggcaccatgatacttttttcactcaaaagggccagcatttatgggatatactcagtcagattctcaaaattgcttcagagaatcctctgttagattaaaggaggtcatttaatcaaacgactttccaaaagtccctgttttgaattactggagagaatgtgtactatcagggtcctggatcacttagcaaacatcagaggaaaggtttcaagtctgttttgagaaatgtactgtccaactctactgctttttccttcagcaaaggagatttatcaaggataaatttggttacagacatacctgttttcgttaaaatgcctttggccattacattatctgtaataactttcagtaaggtctaagcaatttagaataatattaatagaaaaaaatcatgattctctacaccattttcccttccattttatctaaatggctagaagtgagtgtttgcataattttttctagtgtttttctcccattttgccatgatctagttttatatggaagtcataaatttgttctaccaatggagtttgttaaaacaatattttgactttgcagagatcattgtatattttctatttattttaatgccaaacttttaaaaatattgactgctaggaacttaagagagcagaaatatcactttgaaaaatacaaaaattcatttttttctagttgatagcttgtcttttaatattcattgtggtatatctgtgctatgtaatattataagccttgtatctgtctcctatactttcctataccctcacataaatactatggaaaattattatgtgcatcactacccaacactttagccttgacttaaaacggtaagataatttcttgtaaacaggtatctgagctttaaaaaacaaacaaaaacacattcctgttagctctaactttgctcagatcccttgagagagatcagaactcatatgaaaggtgaacagattcttccctttggcaagcaattccttcaggaactgagttatgcttatggtgggacttccaattagaaaagtaaattttaaaacaaacaaacaaccaggctgttcagagattgctagacacaagatcaagtcccagccaggtgtttgacattgcccagtctctttactcttgtaatgtgaaacttagagtcagcttcttcactagtgtttttggcatcatagaaaccacacacctaaccataaatacaaaccatagctggtactaccagtgcagttctcactcttgtagaagcatgtccagtccttctcaagtcatcaactaacaagaccaaatgcacatttctagcaagggagtccttgagcccatccagtcccctgacttcacagcgatgctgtggcagcccactctgctgccgcccacaagcacacatggaggggaagccagcagggatgtccaggtctttgcccatggcctgatgaagaaaggcagctgcagtcatgaattcatagaaccagaagtgacattagcagccacctactccaactgctttccaagagaaatttctcaagagacatgctgaatttcaagtcaagaacaacttggaagccacaaactcagctggcttacagttgccatggaattttgggacttttgctgcaaacagaaacaggatccacaggttataactagctactgaccagtgttacagagcctgtggacaatctcattcctggtttctcctacctctcttcattttcctgtgttccccaccatcagccctcctctgggtcttctccctttcttactctgttctttttaccagggaagcctcatccactctaatggcagagtgctagttttccaccgaagatttgcacacacaccccagccccagctgagtagtggagaggtgttgcccggcagctgtacttgctaatggcatgggaacaaagtgttttagagtggaggtaccttttccacctgctcatcttctgcctaccatctagatgccaatgctcaaggcaatggtggatgccctggattgaagatgacagaagtgtcatcggtctgaggccctaaataatgccatagaccagagctaagctgtgttcctctccatccccttccagacagcctgccaccaatcaggaacactttacatagtgagaaacaaacttcgattttgttaaacccttgagatttcaggctttaactattgcaacagctaacattccccacctatataattataaaatcttcagattccatctatgctaattactcccaattctgcatctctggcatagactttattcctgagtttcacaactgcatatccaagtagacaggtccactataatgacctgcaggtcaccaaattcactatgtctgaagccagacaaatgatccactgctttcccacacaccctggccattcctgttccatcatatgcttgtgaataccaattgtatgcacccaggtactcaagagtgccctattttatctcccatactactctctcctaaatatctatcctgtccatcccgtttatctctccttattgccacattcttatctggtttcaataatagtagcctcaccccctactccagtctgtcctccatgctacactagaggtgtctctttgaaataaaaatctgattatgcctctctactccttaaaatccttccatggctctttctgccttgcagattaaaaatcaaagtcctagtgtaacacctaaggccactttatggaccctttgctgctgacctcctgtattctctcttaccattctcccattgttccatttacaatgtatgtcctgaagtttctcaaatatcccttccctccatgctgctgattttgtagtttccagtatccagaacacaccacacccctcctgccagtgtacttcttcctcttcatcattcaaatctcagttcagagatcatctctcttgggaatcttcaacctccacattccccttagagatcacgcctctatctttcttttcctcatggcttctgcctgcttcatagagttggcatctgcacaattgttagcaaatctaggagctcttgaatctttgccctagtttgatgttctttgagaacagccagctacaacactgcctgcaacatgccctcaatacatgtttctcaatttaacctgtattgtcatccactcctaactgcatatcctgataaaatgatgcatatgtagagctgagggtaatgcctggcttattgtaagcattcagttgatgttaacagaatcaatcatagtttttttgtattattatcattattgcttttattactatcagcaattactcaatatttttgaccatagctgatttcacatctctactaagttttgtttttctttttcttctggttcacaatcatatgggagacatttgcaccaaagtagcggcttccttcttatggctgcaaatgagcggagtgaaggtcaagggatctggagtcgtgggttcaggtgccaccactgtcaccagctgtgtgggcataaactagtcatttaaccgctccgtgcctcattttggccatctgtgacatcaggacaaaaatagcttcctgacccacttcaacagaatagttttgagaaacaacctagataatgaatgtaaaagcattttgtaactctgaaaatgataaaagtcaattattagtagtatttccaatgacataggcaatattagtataaacaatgctttctctgttgaatattgtcattcctctattttgccattatcactttcggttatttttgcatttcctagtgagtggacaacacatgtaagtcatgtgtttcctcatgggcaaattctcaatttcatcatcccaggcatcacataaattctgctttgaggactgcacacagaatcccctcactgatgatgttgctctaaattgacattgtctgtttgtctttgaatctatctttctaataattgtttccttacacggcatttcaacccatggtagacatactgatttttgcatgaatgaatgcttttgcagatacaggcaaaatctttgcgtgcccagagttttgtctactatttcctatttgacttcaagcttctcacttgatgttaatgaggatgacggtgatgatgatgaagactgacatttttgaactcttatataccaggcgttttttaagccctttacatttaatcctcacgatgacttggtcaaaagaattcgtgtgctagatccactaaaacgtaaactccatgaggtacagaatctttcatatatcatcagttttgttcactgctaaatccttggggactaaagcagtgcctggcatatagtaggcgctcaagaaacacttgttgagtgaagttatttgcttctcaaatgattttttaattatcaaggctttggagttttctgagcatctatagtttgacggtgatttcttattggtagtaacagattattattgaaattattaactaaatttatataatacattatagtttataaaacactttcacatacataacctcacttaaggcagtcagtgacatttttccactagaaatactgaaatacaatgtctctaccaaatgaaaaataaaatacagccattattacaatactaccattgttccatttcttcaatgagcagtaagcatttaaattaagaatgactagggtttctaataaggattgtcaagtatcagaattgttgggggtttttttaattgaaagaagaaaatactagaaaatatttctccagttggcttagaaagaaggaatttccatttgagttccaaatttacttaacaatctggaaaggtagctgcaagtctgattctggtaagtgtttgtgtctccgaaatcagtggcaacaaaatattttaaataaaccaagtaaagtttttgagtatgtaattaaaaatagaactgatgagatcacttgccaagaaccgtgaggatttgcattaaaaacaatgatttgagacagtcatgatttattcagcacattctacccaatgagagaacaattcgtatgaaagtcagggagtgctcagctatgttatagaaagtgttgcgtgaggtgtctgtggtgctggagtaggataacattttctataacttgagcagtgtgtctctaaatgaaattgtaaaatattatgatatgttaaaggccaggcaaaattttataaccagaatacaatgatcatttgcactgaaacattggcatctgtagttgtcactggtttttagtaggtgaggggaaatatctcttcaaatgatcagacaagtatgactagtgcatttgtcattccagtgtcttcggcacttgaagtttttccatttttgttcaacaatgtaacctttggagttttgcctaataatgacttcacttgtgctggccttccaacagataaattaaaatggaaatgcatattttctaattatgcatcgagccttagttgcatattggcgagggtggccacaccgaatgttaaattaagtctgcacaatagttagagtctatgtaacatcaaagtttcccaaagtcactttcttaatcatgtgaaggatagccaagactttgatcagtagtatgtagctatatacgatcagaggaaaaacatttaaacatcccagcatggtatttccatttaaatctgattacagtgaaataaaactgtagccattaaaggtttaaaagaactacaaatacagcagtaaaagaagacagatagtaaatgaggtagtaaaacatttcggcagggcaaacagtttacagcactcattcagtcgtcctgaagcagactgtgcaattcactacagacctggcaccgttccctgaactccacttaaacctacaattaacctttcacacctaatgaagctgttttcctggaaaattaaaatatataatggtgcctgcttttacacagacttcagaggagagcatttcaaagtgaatgacttttctgaggcttttgttcaaatgtaaaatggaagtgctatgtttgtatataaagcgggaatgttctttccaaggcaatttcatttgatgtgcagtattttattactgtacttattaattgttctgcataattgtaaaaaacacacatcagtaattttatgattagattgttactgctgaagtctgctattaccatttcacttccattagggaaaactagagttttgctaacaataactaaattcctgatgtttctccttggtggttttcattgcaaatttagtggtttaaaaagacatgtttaccatttaattatttagctgttatttacattgctgtctcttcaggtcatgttttcacatgtttcaagagaaataaaattcttaaatttcaggaggcatatattgtttttttctaaggttgcaggtgaaggtctgattttggtgtatgttctacttatttacaaaatagctgtggggtactcccacattcatttcagcattattcacaatagtcaagatatagaagcagctatgtgtccatcaacggataaagggaaaaatcaataaagagaatgtggtctttataaacaatggaatattatacagccttaaaaagaaggaaattcagtcatttgcaacacatgaatggaactggagcatattatgttaagtgaaataagccaggcacagaaagacaaatactgtatgacttcacttatatgtagaatctaaaaaaggtgatctcagaaattgagagttgaaagctgattaccagaggctaggggaagggggagggatggggaaagggaaggttttgatctaagggtacaaagtttcagttagactggaggaataagttttaatgatctattgcactacatggtgaccacagttaataataatgtattatatatttcaaaacaactaaaagaatagatttttaacattctcaccacaaaaaaagatggtaagttggagaggtgatggatatgttaattagcttgattgactctttccacaatgtatacataggtcaaaacaccacattgtatctcataaatatccacagttatttgtcaattaaaaataagctttaaaaatagctgtggtaactcttggcctccagcccagggaccactgagtcgtgcccattttctgagggaatttcctatggtctcaaaggagcctgtttcctttagggcttgtcctgccctaggtgaaccagagcagccactgggcctgctctctgttagcaaggaccagtttgaaaacaccaagagaccatggaaaattgaacaggaaacagaggatggtatgttccttcctatgcggtttatacttcctatttaaataatctaaatgtcatagtgtctggtgtttaagaactaaaagtacaaaaaggtaaagcttataataactattgaaaccccagcatttttgttgaatctactggtatatttttatgtaaatcctgctagcctgcagcatctgtgcatcatctttacgtggtaaatgaaattcctttggaccatcagtctaaaataatgaattgttcccccagttaattgtattgctttgataacaaggaactatgctaggcctagagaacacaataagtgaatttcatcagatgatttgtgtgacgtcttgaaaaatgatcttctggagtgacctgattttaatggaactctagcggcgtgcagcatgggcccagcatccaactaggaggaagcacttcctcctatggcacaagaagtgcgggatcatccccagaagacctctcaccaggaaaaattctcaggaaagtcatgagaaagtgtgtgccaaaaatggcaacacaaagaacctatttctaggttgcttttcttttattgatacataccttttttaaaacccagaaaagatcgcaaacgacctttatgtctttgttgccagcgtgaaaataaaccaagaccaagcaaatgaaaataagcaaaagctatgtattctgagcttgctatagcaagggagtcagccactttcacttgtgttttggcggagactcaaggacaggcaggaatgggaaatctttatagtgaaaaaagggaagcttcaggtgtgccctgatgagaggccgttagcttgtgggagctgtagacagactaactagaagtggggcatcctatgtggttaggggtacatatttggtttcctctggctggaagtgaggacataaattagggaagctgtttattaatcaagtcctggccatttggggccagtcgtgacagggattacagtttaacttcatgggttattagtagagatagcagtctgacttcttacaagtctgacatagcaggctggcttcctgggctggttattgcagattatagctcggtttcctgagcacgttgccacaagttgtgggtcagaattctatttatacatggtctgggcattatctacatgttcagtatcttaccagaatataactgctacatttaggggacgggggaggtaatacagtctttttaaaaaagctattgacttggcttctcttttcatcagttaagaaaattagattccttacaataacaaagtgtgctgaaaggcaatgacagagattactctctctctctctctctctctctcttctctctctctctcttttagtgagtcttccatacacactatcgaattcaataagataggggctttgtctctttttttcattcttgtatctaggttctcttgtaggttgaaagagaacgtagcaacttctgatgtttttaaggttcaccttatatttaacatgaagaaatgcaaaagtagtaataacttgatatttaaggcacacacacatataaatgcagttattatgattattatcctgttcataattaaactacaaggtttataaagaagaataactcatgatgggccacaagccgtggggtccagtaaaggacctaagccaaatgaaacattgtttggcccatcaaatgggcagataagactttgggcaaatggccctgagtgttctctgtgagtgcaccacggcgaacacttaaatatctctgcctagagaagtgcaagcctttctacatacacattgccatttatgcagatctgaaaatgcagttgattgttacattttaataagaaatgacaaaaagctgtcaaattaaaaataagcatgatttgcaattttatttgtaaattaagaactgaaatatttatgattttcaactgaatgtgtttccaagtttcagaatcattagtaaacccaggacatgttgtcagagacattgcttcagttaggttctggacttcatgaaatacagcgatacagtggcagttttggattagcgtagaatttcctgttttggcaactcaagctgcttactcctctcccgatgctatatcttctgtaatgaaaacatttgcattcacatgtaaatggaaagtattattttttcagagcttctttggactacatcatgcagtagtttaatgaataacatgatttcatatttggatgttgtgatcattgaaattagtgtaagtggtctctgtccacattaaaggagacatgtattatttgtcatatttggctgtctctggattagttggtgccaggaataaaatagcaggaagttgtaaataatgacagaagtatgccagaagatcagtggaaacttacagtcagcttgaacttttagttagcaccaccaaaatctgcaattttaaaaataataacaaggtccttcagctccattaattaaacaaataatgaaataattatttactactgcagaataagtgtttaaaacatctatgttggactcttcagaagttcccacgtgctcttcaaaggtcaagaaaacagcttttatgtaaactttgaacttgtaataactctaaaacattcaggatgatatttaatatcctgaaagagcaaattacttaagagcaacccttaaaaggtaaatctgtaaatttatcagcttagccagagcttattataattttgtaatttctttccttgctaacaccataaatttctccttctccacaaatctcttctgttttcaaatgtatccaaggctcccttttcctttaaataatgcacttacataattccatgcatccacataaattccatctgaccctgctaattctgttatgtagataagcttccttatctcttcccattgctaaacatcttaaacatggaacttatgtctgctggccgtacttcctgtcactccattcgttgtttaactttcaggcttccatcctcagttagataccgaaatgactcaaagatcatcagaatcttcttggaggaagtctaatggcctttgccacaggccttaccctgctggcccatttgccactttttacagactccttgggcttggccctcccttgactcccgcaacactgcactaggctagtttgctttcctcttacagtgctcacatccctttactgtcatttctttctgtccataaatctctgaattcagttcctgccaggaaatatgtgaagcttacccagaattaactgacccacaggaataaaataatgatattctacgtaggataagatctgaaaatgatcttcctctaagagcaacatgtggagaagaggtcagctcaattcaaagtcaagtcttcaagaccttgtagaaaggaaaatgagccaaaagtccttttgtggccttttcttaagcaaggccaatctggcctcatggtttagtatggtgatttgatacatttggttttactcaagagttatatgggactcaacagatatgaaaatgactcatatgtagctatgataagccaaattatctggttgagccatggctcctataaatttaatgaaatctttactatccctgagcatcttaccaagtgttcctgtccatcattggacaaacaatgtaacaaagcagatcaacataattaaacaatatgcttcttaaattacctatgatagctacagctccgcatttgtggtcacattcggtcaataatactcaaggtccttttctagtacttaagacgcttgtcagctaaatgtcaagtggtctttcttccatgtccatttgtacatagcataactctatccatggagtgcttttgtaatttttaaaacagtttatgagaatgaaaagtcaagccatagactgggaaaaaaatatttacaaaacacatatctgataaagaactgatatccaaaatcttcaaagaactcttaaaactcaacagtaagacaacaaacaacccaattaaaaacaggcaaaatatctgaacagacacctcactaaagaaggtatacatgtggcaaagaagtatatcaagaggtgctcagcatcatatgtcattagagaattgcaaatttaaacaactgcaagatactgccacacacctattagaatggctaacacctaaaacactgacaacaacaaatgctggtgaggttgtgaagcaacaagaactctcattcattgctggtggaaatacaaaatggcacagccactgtgaaatacagtttggctttttttttttttaactaaactaaaacataagcttaccatattatccagcaatcaggctcctaggtacttatgaattgaaatgttatgttcacataaaaacctgcacacagatgtttttaacagctttattcacaattaccaaaaattggaagcaaggacaatcaagatgtccttcagtagtgaatgcgtaaacaaactatggcacatccgcacaatggaatataattcagcaataaaaggaaacgagttatcaagccaaaaagaaaaaaagagatggaggtacgttaaatacatatttctaagtgaaaggagaccgtctgaaaggctacgtactgtgtgattccaaccatacaacattctggaaaaggctgaactacagagacattaaagaaagatcagtggttgccagagacttggggaaagggggatagattggtgaagtgcgggggtattttagggcagtgaaactattttgtatgatactgtaatggtggataccctgcattatgcatttgtcaaaaccaatggaactatgcaacagaaaaagtaaaccctaatgtaaattatggacttcagttggtaattttatctcaatattggttcaatttttctgtaaatctaaaactgcttgaaatgtttttaaaaatcttaacatgactagttttgttcctaaaaaaaaaaaaaaaaaatagtaacatttaaaatttctagtacctccacagcaaactcgtgttcagacatggagaggaaggtttagggtcatatgcacaactaaatgtgatcatttgtcaaacactgatttgattgttccaagtcagagtcagttaactttcttagatctttcttcttcttccttggtgaagttcacatgcccaagtcaagaaacattttaggtaaagggcaaactacttgaaaacttccattaacagccaaacgtgtgatgactaaatgaaaagcaataaaaagcagggcccttcaccaccactgttgccatcccagaaatgtctaagcaagcatttaaatgcttttctctttccttccaggccttgcaattgccagtgccctaatagatatttcacaacagaaagcttcagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagtattgatggtcacaggtgataaagtcagtttttaccactatcttaggcttattatagctaacattaaattactctggaaaaagatgtatattgtttcttaatgaagatgaaaaatatgtaattcatataaatcaactgtttatatcccaagacttgaaagaaagacattttttaatgcctgaatgatgagaattgtacagtttttgcctcataagcaaacttgaatcacctgtgtatgaacagggaatgaacacattgcaatggctttaaatgctcttttatctcgttgtaaaggtaaggcaagattttgatgtagtaggatgtaggtaatgtatttaaatatttcatatgaccatatcgtgtccaaactcagtctgagaatgtgacagctttccgcctaactagaatgcagaccagaatgagttcaactcattctgtgcaacttcacagggggtttattagaatgctcagtgtagaggacattcctgtcatccatgccaactacctaactcgttatcagagctgatagagcatggaaaagtctgtccagcgatcagttgttcccctccttccaaaaacagcctccaataccacaacctgaaaagagccgaaatggttattttacagcatacaagcttctgctccagtatgataatttttaattgcctaagaatcattggatcagacctaaatgatccatctgcatttttataagaatggatctttctttgcccttcctctcctagctgctagattttaactaccttttacaaatgttacaaaatgtattttagaggcgacatctctcaagatgacctgagttccttcctgccaactgttccacctagaatacaagtagagaagagcactggctggcaagcatcaacaggagtcttcttcccaacacgagcgcatccatgtcctgagaaaaagtctgtggtttagaaaatatgtccatggttgcccacagtcagcacactcttagtgactcaaaattctgaattatggcagaaaggaaaaataaaacatacttcacattagaacacagaatcatttacatcctaatactgaccacagttcactaaagctcagtagcattaacagatatagtttggaattgcagtttcctcacttcagggtgacaagatatgtataacagtgacagaaatctccaaagctgctgtatatgatatagctttgttaaatatgaaggtcctttaaatacaattgatgtttagtactatatatgtacttttcacattctttggatttctggaaggttatgacactttactgtttacagctaatgcatagttacttgcatgccatggttgtacagtagcagactatgaccctattgtgatattaagtgtttatttcataatgccatttatacatagctgaatttgatgaggattgaatgtcatatataagaggaatgatcatacaatatgtagttgcatcttatataagatttctaggttgcatctaaccatgactatgtcattattttgataattaggcatttatgaattatagtatatattcctcatgttggcatgataattttgctattttccatgcattaaaaataagacaaattcttagagtaattttagtaattttatctataatctgtggggtttttttggagggggaggccactggttgtttctacttccctgtgatattttctctctcattaaaggaatgagctaagtttgtaaatatctcctaaaaacaatcaagtaattttattagcttcttttggaccctctaaatattgacttctctcatgaaaaaataaattgatgaaactaatgattacaaagatataatcattttttaaaaagtgattgcccaatgtatttctctaacaattgtcacaagagaaagcataacaataaaaatacaaaaacatacagatttagatgtaaaatctatataagctatatttttagggaggctaagcagatagtattactgtggaagaattatcaagttttattcacctcaaatcccactgggttcttaaaacttgaaaattcaaattgtagagaattatgagacacaatgtgatgtttagttaaagtcatgctatacctttctgggccacatattgctaactctgtggctaattatgcaattaattctcaacgtatcaaagcttttcactggcagtaaattctttgccctcaggtgaagtggattgaaaagacatcaaggatcaaggataatcactttgaatctgttggtttttccccctacattccagacactttaaatttggatgctttcattttttttaaatcaaaccacacaaatatgcagatactttcccagaatttcgcagttaaatggctgatcctcttgaaaactaaccttaatggaattctaaacatttcagtttagaatgactttgaaaaattccttagatttttaggatgttttattctgccaagtatgaaaaaaaaatggttaaatacaatggagttttaaaaattaacctggggattctatttgaactagaaaattcctattggaaaagaatttgcacatacttacagattcagctaataaattttaagaggattaggattctcataattctttaaatgaaaatttgttttagtgatacacagagatgccgtatactatagtgttatgttcagtaggaaaacttcaaatagttcgtatttaaaaaggtaattgatccttgctgtacttcccaacatctcatcttcttttagctgcagtaagatagaggtgactgtatggctacagttcatggtataaggtcatttagggtgcacactggcacacaggctggaaaacgggcactggacccagctttcaggtgtgtggtgctgggtaagtttcacctttgaagcctcagccttccatctgtaaagggcggtaatggtgcccacctttcgaggcattgcgaggctagatggtaacacacagaaagctcccacagtgggaccttgatgcagcgtagctggtattaacaaccgtggggacaccaggccactctttttctaccagttgttttatgaatccacctattaattttcatccatcttttggtcgtaggtaaaggtcaatcaggtttttcaaaaagactccctgaataacttaagttcctgtatttctaagatatagggatttctacaaaacgactttgacatttagtcaataaagacttaaactcttcttaaatctatagttttaggagagtttttcttaaaattactgactgatgacattgagacaagagcatcaatgatcacctttcacgtacaaactaggcaagacagggtcagtgcttacattttgtggttatacatgatacatcttttctcagtgaacataaaactatgatttgaaaggtgtcttatatttaaaaaagattgtaaaatgaaaactgaccaaatgaactaattctacccacctatggtctttttaaatgtcgagtttcaaaacccatttgccgtatactagagtgagcttggaaacttacctgattacaggaattgcttgggttcaggcagattcccactttcacctctagagatttagattcagaaacactggggtaggccctggagagcagtactcttaacaagctcctcagtgcttcttaccattaggcaaattagggaaacactgcattgggtcaaagtgctgcctttaatcgaccattagagggagttctctaaataacaaagttattactctaattcaaaatgctttaaagaattttccaaggaatacaagccatctggttggtgttagttatagcagtgatttcattagagtgtacatttaacattttagttttatcaaaattttttgaaattaagaattagaaccagagctcctatcagtatatatgtacacaggtgtgcatgccagtgttcaaaagattgtgtaaaagttcaagcccgttttagaaagccaacattttatgttataatatgctgttaatcaggactttattaaataaaaacattggctcttccaa

SEQ ID NO: 1105 - DNA, 64171 bp, Homo sapiens
gccatgttgatttctgatccttggtatatgacttgttattttctatctgaaagtgtttcagatcttctcttcacccctgatagtctgaagtccagtgcttccatgggtctctatgctttcatcaccctggacacctttttaatctagagacttgtatatttcagttctggatattttcttgtgcgtttttctttttaaaataataatttcttttcctttgttctctctttttgaactcctttcgtttgaggttagacttcctggattgatcctccaaacctgtttcctttttgtttctttctctttttttttctcttctctctagtttatttccctcgatttcaatctacgatgcttctactggatggtaactttcaactctcataattttaatttcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggtaagctgggcccagggggtaatgataaaccagggtcagctgagggtggctgtaaggaatatggaaggacagagctggagggggcgagcaggctaactacaaaagatctggagagaggccaggcacggtggctcacgcctgtaatcccagcactttgggaggctgaggtgggcagatcacgaggtcaggagatcgagaccatcctggccaacatggtgaaacctcgtctctactaaaaatacaaaaaattagccaggcgtggtggtgtgcacctgtagtcccagctacccaggaggctgaggcaggagaatcgcttgaacctgggaggcggagtttgcagtgagctgagatcatgccattgcactccagcctggatgacagagcgagactccgtctcaaaaaaaaaaaaacaaaaaaaaagaccttgagaggaagggggaaacccggtgggatggaaatgggttgaccttgactgctgaacaggaattaaggggcgggttctgggagcgggacagggctacaatgtgagaagggacggaggaggtgcagagctggaagacagatctaagcctaggagagaaggattgaggggtcaggccctcaggaaacggacaagacccagggtggacccagctgatgagagagacttaagtacgaggcagcaaagaaatgacggatgacaggccaagcgcggcggctcacccctgtaatcccagcactttgggaggccgaggcgggcggatcacctgaggtcaggtgttgagaccagcctgaccaacatggtgaaaccctgtctctactaaaaatataaaattagccaggcatggtggtgcatgcctgtaatcccagctacttgggaggctgaggcaggagagtcacttgaacccgggaggcggagactgcagtgagcggaaattgcaccattgcactccagcctgggcaacaagagcaaaactccatctcaaaagaaaaaaaaaaagaaatgatggatgtcttggtgtcctgcagtgtgtttgggagaatttgaacaagtagaacttcaacaacaacaaaaaacagagggctgagcacagtggctcccaccggtaatcccagcactttgggaggccaaagtgggaggattgcataaggccaggaggtcatgaccagcctgtgcaacatagaaagaccccatctctataaaaaataaaaataaattagctgggcgtggtggcatgctcctgtagtcccagctactggggaggttgaggtgggaggattgctggagcccagaggtttgaggctgcagtgagctgtgattgtatcactgcactctagcctgggtgccggaaaaaaaaaaaaagaaaagaaaaaaagaaaaaaagtcaagtcagacacattcactgcataaacactgatcatccttacgtgaccactcagaaagctcacagtcactgaatcttataattcttgataatgacacgagttgcatttttgctttcttcaaacgacccccaaggaaagagaagcctccggaccagaagctggttgttcgcagctctagggacaactgtgagttggaaaccaggagtgctaagatttctcctccctcctccgaacccacattctgccaccagaatgccagttcctgagttcctagcaggagcagccacctccagtcccctccgggcatcagccaggactacaaaatgtgtcctgccaggccaagtccagccctccaacctcagttcatgaccccggaccttgtcattctgtccactctcccagccccgaatttctcctaaaagattctctctttcaaatctctgctctgggccgggtgctgtggctcacacctgtcatcccaacacttagggaggccaaggtgggaggatggcttgaggccaggagtttgagagcagcctgggcaacatagtaagactccatctccacaaaaaacagacgagcaatttctgctctggaccccaaggctttgcaacagctttctttttcttttctttgagacggagtctccctctgtccctcaggctggagtgcagtggcgcgatcttggctcactgcaaagtccgcctcctgggttcaagcgattctcttgcctcagcctccccagtagctgggactacaggtgtgcgccaccacacccggctgatttcatggcagctttctctaagtgtagcaatcttgctacttccctctccctgtgtggctctgggccctgcccctgccctctctgaaacctcactgtgacccattcttcctagatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggaggtgaggggctatggtttccaggggaccatgagcagggaggtggctgggaggcgggagtggctagatggagagagaagggaggcagccagacctggatgcctgggctctgagaaggggatgggtgggggcagccctcagaggtggctgggcctcagtgtcttgggctctgcctcccccagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccgggtaaggccggggacaaattgtgggacctcgggggggagtctgggtgttggagagcctgagggtgggggtgtggcaaaaagggattgtgggggccaagccatctgaattcaggaagaaaactaggagccaggaggcctggctgaggggctcatggggttggggtccccttatcctcttgcagctgatgtttgagggaacacggggtagcactgcctacctggacatcgccctggatgccctctctatccgccggggctcctgtaatcgcggtgagtccctgtccctcctcccgcctgccctcggacccttttctctccgtccttgcacaacaagaagaggatccagggcgggcgcggtggctcatgcctgtaatcccagcactttgggaggccgaggcgggcggatcacgaggtcaagagatagagacctttctggttaacacggtgaagccccgtctctactaaaaatacaaaaaattagccgggcgcggtggcgggcgcctgtagtcccagctacttgggaggctgaggcaggagaatggcatgaacctgggaggtggagcttgcagtgagccgagatcgtgccactgcactccagccttggcgatggagtgagactccgtctcaaaaaaaaaaaaagaagaatgagaaaggagatgaggagctggctgtattgggtctgccaggtagagctattagggctttgactctggaagcagccgtgcctaaagagaggtctcggcccagcacagtggctcaggcctgtaatcccagcaccttgggaggccaaggtgggaggatggtgtgaggccaggagtttgagatcagcctgggcaacataaggagacccccatctctacaaaagaatttatttatttatttatttatttatttgagacggaatttcactcttgtcacccaggctggagtgtagtggcacgatctcggctcactgcaacttctgcctcttgggttcaaatgattctcctgcctcagtctcccaagtagctgggattacaggtgcccaccaccatgcctggctaatttttgtatgtttagtagagccggggtttcattgtgttggcaaggctgttctagaactcctgacctcaggtgatccactcacctcagcctcccaaaatgctgggattacaggagttaagtcaccgtgccaagaactttttaaaaattagctcggcatggtggcgcacacctgtagtcctagctacttgagaggttgaggtgggaggaccgcttgagtccaggagttcgaggccgcagtgagctatgatcacaccactgtactctagcctgggtgacagagaccctgtctctaaaaaagaagaaaacattatatcttcccttctttctttcctctcagtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtgagtagcggccatgcttctgtcccttgactttctgggcaccaagcaccctacgataattgccctgggacggtctgtcatgaacacctacagcttcaagcctcttaccagctcaagtttcacgcaagaagctgatttcaagcacccagccagcctcccccaccaccgccctacaagctctacctggcagacccaatacagccagctcctcatctcctttctgtggctcttcttcttcttctttctcttcctcttcttcttctccctctccctctccctctccctctccctctccctctccctctccctctccctctccctctccctctccctctccctctccctctccctctccctctccctctccctctccctctccttctccttctccttcttctttttctttttttttttttgaagcagagtctcgttctgtcacccagtctggagtgcagtggcgtgatctctgctcactgcaacctctgcctcctgggtttaagcaattctcctgcctcaacctcccaagtagctgagactgcaggcgtgcaccaccatgcccggctaatttttgtatttttggtacagacagggtttcaccatgttggccaggctggtctcgaactccggacctcaagtggtccacctgcctcagcctcccaaatgctgggattacagcgtgagccattgcttctggcccctttcattcttcattcattcaagaaatactgagcacctacaatatgccaggtgctgtcctaggcacttaaaatacaccagtgcagaaaacagacaaggaagagtagggtgtggtagcgggggggcagttaccgacacaaagtaaatatagttataaagtgagcgatgctactgggaaaataaaaagtcaaacaagtttggagccaagtgcactggctcacgcctgtaatcccagcgctttgggaagctgagacgggaggatcacctcaagtgatctgcccactttggcctcccaaagtgctgggattacaggcgtgagccactgtgccccgccgtgagttatcaattatttatttatttattttggagacagagtctcgccctgtctcccaggctggagtgcagtggctctatctcggctcactgcaagctccgctgcccaggttcaattgattctcctacctcagcctcctaagtaactgggactacaggtgtacaccaccacgcccagctaatttttgtgtttttagtagagacggggtttcaccacgttggccaggctggtcttgaactgctgacctcaggtgatccggccacctcggcctcccaaagtgctgggattataggcgttgagccactgtgcctgggcgagttaccgattttaaataggctggtcagagtaggtcacattcaggacacatttgagcacgaacttgaaaaaggtgaggtagtagcagaggacattccaggctgaggggccagctgtgcaaaggtcctgaggtagcagtggggctgtcggggaaggaggggatcaaggcacagcaaagagccatgtggccagcatgaagagggtgacctgagatccacaggagcggcagatcacatagagccttgaaggccattgtcaggactgtggctttcctattctgtgtgaatggggagcctttgcaggattttgagcagtgacttgatctgacttatttatttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgaccccccccacctccctcccggatggggcggctggccggtcggggggctgaccccccacctccctcccggacggggcggctggccaggcagaggggctcctcacttcccagtaggggcggccgggcagaggcgcccctcacctcccggacggggcggctggccgggcaggggggctgacccccccacctccctcccggacggggcggctggccgggcggggggctgacccccccacctccctcgcggacggggcagctggccgggcagaggggctcctcacttcccagtaggggcggccgggcagaggcgcccctcacctcccggacggggcggctggccgggcaggggggctgaccccccccacctccctcccggacggggcggctggccgggcaggggggctgaccccccccacctccctcccggacggggcggctggccgggcggggggctgacccccccacctccctcgcggacggggcggctggccgggcagaggggctcctcacttcccagtaggggtggccgggcagaggcgcccctcacctcccggatggggcggctggccgggcaggggggctgaccccccccacctccctcccggacggggcggctggccgggcggggggccgacacccccacctccctcccggacggggcggctggccgggcggggggccgacccccccacctccctcccggacggggcggctggccgggcagaggggctcctctcttcccagtaggggcggccgggcagaggcgcccctcacctcccagacggggcggctggccgggcggagggctgacccccccacctccctcccggacggggcggctggccgggcagaggggctcctcacttcccagtaggggcggccgggcagaggcgcccctcacctcccggaccgggcggctggccgggcggggggctgacccccccacctccctcccggatggcacggctggccgggcggggggctgaccccccacctccctcccggatggggcggctggccgggcggggggctgaccccccctcacctccctcccggacggggtggctgccgggcggagatgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaagcgctcctcacatcccagatggggcggtggggcagaggtgctccccacatctcagacgatgggcggccgggcagagacgctcctcacttcctagatgtgatggcggctgggaagaggcgctcctcacttcctagatgggatggcggccgggcggagacgctcctcacttcccagactgggcggccgggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggttggcggatcactcgcggttaggggctggagacccgcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagacggagacggagacgagggagagggagggggagggggacggggacgatctgacttattttttaaggattttttttgtgttgagaatccactgaggagaacaggcaagggtcgatgcagagaggctgtttaggaggcttttgcaaaaatccaggcgacactctttctttttctttctttttttttttttgagacagaatcttgctgttgccaggctggagtgcaatggcacgatctcagctcactgcaacctctgccttccgggttcaagcgattctcctgcctcagcctcccgagtagctgggattacaggtgtgcgtcaccatgcccagttaattttttgtatttttagtagagatggggtttcaccatgttggtcagggtggtctcgatcttctgacctcgtgatccacccacttggcctcccaaaatgctgggattacaagcgtaagccaccatgcctggctgatattctttctttctatgcacccaagtctatccctagcttctttccaccacctccctgtgcactcagctgagcttctttctctttctactgttgacttcttccttttctctctcacacaacattcactttctctcttaatcttctcacacagcccacatttcaacccctcactgagccaagcactgtaggtcaagcatagagggttctgctccctaatttcctgagtttataattcttatttttgaatttaaaaaaatgtttttaaaaactaggccaggtgcagtagctcatgcctgtaatcccagcactttgggaggccgaggtgggcagatcacttgaggccacgagttcaagaccagcctggaacatatagtgagatcttgtctctacaaaaaatacaaaaattagcccagtgtggtggcacacacctgtagtcccagatactcgggaggctgacgtgggaggactgattgagcctgggaggtggaggtggcagtgagctgtgatcgcactactgcactccagcctgggcgacagagtgagattgtgtctcaaaataaataaataaataaaaatagagatggggtcttgctacattgcccaggctggtctcaaactctgggcctcaagccatcttcctgcttcggcctcccaaagtgcttgaagtacaggtgtgagctgccacgcccagcctatatctctttgttcttcttttcccttaatacttatcctttctcaatccatttcctcccttccactttaccatttccacactttattttattttctttatttgtaaagatggggtcttgctatgttgcccaggctggtctcggactcctggcctcaagtgatcctcctgcctctgccgtattttcttttctgtttttccccatcttttcctctctccactccatcagtgtccacttggactcctgcactcctgtctctgatctttcctgctgcctaaactttgttttctagaagggccctggccaggcgtggtggctcatgcctgtaatcccagcactttgggaggcggaggcaggtggatcaccagaggtcaggagtccgagaccagcctggccaacatagcgaaacccgtctctactaaaaatacaaaaaattagctgggcttggtggtgtgcacctgtaatcccaacactcgggaggctgaggcaggagaattgtttgaacctgggaggcggaggttgcagtgagccgagatagcgccactgcactccagcctgggcaacagagtgagactccatctcaataaaaataaataaataaatacgtacataaataaataaggccttaagaagccctggccccaccttcactgaaagccgaccagccctctctgcaacccctcagcatttagcaccgtgtaccgcgcccagcagcttcagtaaatgctggttggctttttatttttcctttctttccctttccttttccatcttgctcgcttccttatattttcttcacctttcacttctttttctcccatttctcctcttctgtttctcataggtctccttggttttttttttgttgttgttgtttgtttgttttttgagacagtctcgctctgtcgcccaggctggagtgcggtgacgcgatctcagctcactgcaacctccgcctcccgggtttaagcgattctcctgcctcagcctcccgagtagctgggattacagatgcccgccaccacgcccggctaatttttgtacttttagtagagacgggatttcgccatgttggccaagctggtctagaacccctgacctcaggtgatccgcccgcctcggtctcccaaagtgctgggattacaggcgtgagccaccgcgccagcccgtgtccttgatttctctttcatcattttcccacttcctttcctttcccttccctcttccttcccggttgtttcctttcttctccttcctcccgcccattcccgccattccagcctcttcgccgccgctcaggatcccaccttcggcaggagtgagcgcgcgccaggcaagactcccttggactcgggcgtgagcacgcacgcgagcgcgctccccacgagtggcagccgcttacattttctttttcgctaccagttgcgtcacctagcgaggtccacgctgattggctgtctgagctgggggccgaggtggtgttgggtgagagggggtttgcctcttgctcctctgtgtcagagccgctgtatctctcgccagtttgcgtgaataggttatgtccagcgggtaaagaaaaggaagaggcaatcgggtgtagtggctcaagcctgtaatcccagcactttgggaggccaaggcgggaggattgcttgaggccaggagttcaagaccagcctgggcaacatcgtgagaccgcccatctcttaaaaaaaaaaaaattagctgggcggactccaggtccgcacctggagtcccagctactcaggaggctgtggcaaaaggattgcttgagcctaggagtttgagacctgtgccactgcactttagcctgggcaacagaaccataccttgtctcaaaaaagaaaaaggaaaaaagaaaaggaacaggctatgactctagtggaccttaagagttagcacccaggccagatgtgatggctcatgtctgtaatcccagcactttgggaagccaaggtgcgtggatcatttgaacctaggagttcaagaccagcctgggcaatgtggtgaaaccctatcttttcaaaaaaaaatgcaaaaattagcagggcgtggtggcgcacacctgtagtcccagctacttaaggaggctgaggcgggaggatcacctgagcccggggaggttgagtctgcagtgaaccatgagagccatgattgcgccactgcactccagactgggcgacagagtgagactgtctcaaaaacaaaaacaaaacaacaacaacaaagagttagcacccaaaggtcaaagttctagttgctgctttggagaaggtgtccgccgcttcccatggcagcgccgggtccttacccagcccaagcatttctaggaaaagttgaagacctcagtcagttgggataggaccacctcagtgctgcctgattctaggctgctgttggggatccccagagacaagtccacagcctcctcagggccctatctctgctgccatcttccctcaattccatccaccccagttccctggccttttgcttcacaggtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttgggttagagcggagaattaatgggatttacactgatctgggcgcatctcccagggttggcttgatggggaaacatggggcatccctcagggtctagggaggtctggaatatgtgcgagactattccatgaagtggaaatcatggctgggagggcactttgggaggccgaggcaggcggatcacgaggtcaggagatcgagaccatcctggctaacatggtgaaaccccgtccatactaaaaatacaaaaattagctgcctgtagtcccagctacacgggaggctgaggcaggagaatcgcttgaacccgggaggcggaggttgcagtgagccgagatcgcgccactgcactccggcctggtgacagagcaagactccctctcaaataaaaaagaaagttgtgctggcctggcacagtggcttatgcttgtaatcctagcacgttgggagggtgaggctggtggatcacctgaggtcaggagttcgagaccagcctggccaacatagagaaaccttgtctctactaaaaatacaaaaattagccaggtgtggtggcacacgcctgtaatctcagctactcaagaggctgaggcaggagaatcgcttgaacctgggagacagaagttgcagtgagccaagatagtgccactgcactccagcctgggcaacagagcaatactccatctcaaaaaaaaataatgaataaataaaataaaaaagaagattgtgctttcatttggtggtaatcgtccccagctatgccctctgctcctcatcctcctaggtatagttcaaagtcgtttcccagtccccttaagctcacttctccttccaattcctttcactgcagggagtatccggaaacacactctcttctcaggacaacctgggcccaactggcaggctgtttctgtcaattacacagccgtgggacggatacaggtacagagaagcaaggggtcaggtccttgcacatggtaggcacacccaatgttgaaataaattgaggggcctggtgctgtggctcatgcctgtattcccaatactttgggaggctgaggagggaggatcgcttcaggacaggagttcaagaccagcctgggcaacatagaaagaccccatctctacaaaaaaatacaaaaattaggcgggcacagtgatgtgtgcctgtagtcccagctactagggagcctgaggtgggaggatcacttgagccctggaggtcaaggctgcagtgagctatgatcacaccactgtactccagcctgggcaatagagcaagactctgaaaaaaaaaaaaaaagaaagaaagaactgaattgagggtctgggcacagggagtagggattctgggtcctggaatggagtcgagttagatcaggggcttgggggtgtgggctgtgtgctcactcctgctccatctccctttctctccagtttgccgtggtaggcgtttttggaaagaccccagagccagctgtggcagttgatgcaaccagcattgctccttgtgggggtgagagcaggccctgagaggcccggatctctcagaatccggggtgggctgggggagggctggagagcgtcactcaacttgctcaaatatcctattttgatcccccagagggttttcctcagtgtgactttgaagacaacgcccatcccttctgtgactgggtccagacttccggggatggtggacactgggccctcggacataaaaatggacccgtccatggcatgggccctgcgggaggtttccctaatgcaggtgaggagattgaggagcgctcacgccaagaaatcactcagtctgctcccaggtagcaggctggctgctgtgactgatgggagacgttgtttcaggcagtgggaagatcagtccacaggtgttttttcggaagtttccatggtactggaattgtggagatagcagagtaacttaaagattctcagggctggggggtcactgaaatcctgagaaaacccaggcatctcacttcatggagcccaaagcttcaaaacccaccacctcattttcagtctagacgtttatgagtggctcatgcctgcaattccagcactttgagaggccgagacgggaagattgcttgagcccaggagtctgagctcagcctgggcaacatagtgagaaccccatctctagaaaaaaaaatttttttttaattagctagatgtggtggtgtgtgcttgtggtcccacctacttgcgaggctgatgtgggaggatcgcttcagctcagaagtcaaggctgcagtgagctatgattgaaccagtgcactccagcctgggcaacagagcaagaccttgtctctaaaaattaaaaataaaaaaataggccaggcatggtggctcacgcctttaattccagcactttgggaggccgaggcaggtggatcacttgaggtcaggagttcgagaccagctgggcaacatagtgaaaccctgactccactaaaaaaaatgtaaaaattagccgggagtggtggcgtgcacctgtagtcccagctactcaggaggctgaggcaggagaactgcctgaccccaggaggtggagactgcagtgagctgagatcgcaccactgcactccatccggggcaacagagtaagattctgtcttaaaaatatataaaaagaggctgggcgcagtggctcacacctgtaatcccagcactttgggaggccaaggagggcggatcacaaggtcaggagatcgagaccatcctggctaacacggtgaaaccccgtccctactaaaaacacaaaaaattagccaggcatggtggtgggcgcctgtagtcccagctactcgggaggctgaggcaggagaatggcgtgagcccgggaggcagagcttgcagtgagccgagatcacgccattgtactccagcctgggtgacagagtgagactccgtctcaaaaaaaaaaaaatatatatatatatatatatatatacacacacacacatatatatacacacatatatatatacacacacacacatatatatatataaagaaataattttttaaaaagacaataatgagggtggggtgcagtggctcacacctgtaatcccaatgctttgggaggctgagacgggtggatcacttgaggccgaaagttcaagactagcctggccaacatggtgaaaccccacctctactaaaaacacaaaaattagccagacatggtggtacacacctgtaatcccagctacttgggaggctgaggcaggacaatcgcttgaacctgggaggtggaggttgtagtgagctgagatcgtgtcactgcactccagcctgggcaacagagcgagactccatctcaaaaaaacaacacacacacacacacacacacacacacacacacacacacgacattaatgaatgtaatctaggttgctggtttgttattccctttttttcttttttgagatggagtcttgctctgttgccaggctggagtgcagtgacgtgatcttggctcactgcaacctccacctccggagttcaagcaattctcctgcctcagactcccgagtagctgggactccaggcacgggccaccacgcccagctaatttttgtatttttagtggagacggggtttcaccatgttggccaggatggccttgatctcttgacctcgtgatccgccagcctcggcctcccaaagtgctgggattacaggcatgagccaccgtgcctggccgcttttccctttctttgtgatcccaccttctttagttagatgtctaaaatgagcagaaaaaataatgctacgacctgggaaatttgagtgtttgctcagattcccgttcagaaagcaaagctttgctaaagcagcagttggcatgtcctgtgcaggcttcttaccttgcctgttcccttcctttgcctagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcaggtgagagacggaggcgggggtcctgtctgtgtgaggtgagagggccaatgcctgggatctgggggcgccaccagtgctgaagaggtggaaagctggaaagagagccgagaaaaggggaacttcgtgttacagaaagtgagaaaggggccgggatggggctggactgttgaggctggaacaaggcgacattttggcagagaacagattctatgcccagtggaatcacagagttgctggagattcatttttgtttctctctccgtctctctcccttgtcgcctttagcttattttcaagggcatccagggaagcaacacggcctctgtggttgctatgggtttcatcttgatcaatcctgggacttgtccaggtaagaccaaagcccaggctccaggaagggggcggtgccctgaggttccctggagttctctctatgaactgcttaaaatgtgagtcctccctggagcccgaattctcacccagctggctttgttttccatcttcaacacacctctccttcccctgcacttcaagatgtttgcctgggtgaatgtggcttcgataccatggattttgggggctggatccagaactccttcctctgcagtcttgaaggctggacccatatcctattcatttctggcataatatctgacatatattagtgttcgttgagtggatgaaggttggggtttgggagtagaaagagaggtgtgaataagccacccatgggagcccactccagttagatggcagtaaagagggtggtggtatggttttgactaaactccagggattcttatttttctttgcagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacaggtatgaggtggatggagcgtgggccaaggctgaaagtcagagacaatgactaggagacagtcagggaaagggatgcttctggtagaagccttctagttgcttctagatgcttctagtactctcagaggagagctgaagtagtccatggcgacttcagaggaaatggggaggactgcccagagcgagagggatggcagggctggagtgggtgggggtgtcaggactgaaccacgaggcttccttctcgttgtttgttattgagatataatccatatttcataaaattcacccttttaaagtgtacaattctaggccgggcacggtagctcaaacctgtaatcccagcactttggggggccaaggcgagagggttgcttgagctcaggagtttgagaccagcctaggcaacatagtgagaccctgtctccactttaaaattaaaaaaaaaaaaaaattagctgggtgtggtggcgcacgcctgtagtcccagctactcgggaggctgaggtgggaggatcacttgagcctaggaggctgaggctgtagtgagccatgattgtgtcactgcacttcagcttgggcaacagagcaagacatcgtcctaaaaaaaaaaaaaaaaaaaaaaagcaaaagcaattctgtgggttttagtatattcctaaggttgtgcaaccatcatcactttctaatccaaacactttcatcactccaaaaagaaatcctatacctattagcagccactccccactccgccttcccccagcccctggcaaccacacatttctttcctatatccatggatttgccagttctggacagttcatacaaatggaatcatgcaacatgtgagcctttgtgtttggcttctttcactgagtgtaatgttttccgggccatccatactgtagcatgcatcaggacttcattcctttaaaaaaagtatttctggccaggcacggtggctcacgcctgtaatcccaacactttgggaggctgaggcgggcagatcacaaggtcaggagatcgagaccatcctggctaacacagtgaaaccccgtctctactgaaaatacaaaaaaattagctgagcgtggtggtgggtgcctgtagtcccagctactccggaggctgaggcaggagaatggcgtgaacccgggaggcagagcttgcagtgagccgagatcatgccaccgcactccagcctgggtgataaagtgagactccgtctcaaaaaattaaaaataaaaataaataaataaataaatggagtatttcttattttttatatttttgagacagggtctcgctctgtcacccaggctggagtgcagaggtgtgatctcggctcactgcaacctctgcctctggggctcaagcaactatcctgcctcagcctcctgagtagctggggccacaggcctgcaccaccacgactggctaatttttgtatttttagtagaaacggggtttcaccatgttggccaggatggtcttgacctcccaaagtcttgggattacaggggtgtaatcctgtaattacgcctcagcctcggcctcccaaagtcttgggattacaggggtgagccactgtgcccggctctagggtttcgccctgttagccaggctgttcttgaactcctggcctcaagtgatctgtccgcctcggtttaccaaagtgctgggattacaggcgtgagccaccgtgcctagcctaaaattgttttatttttaaatttgttttgtagggatggggtctcactacgttgcacagcctggtctcaaactcttggcctcaaacagtcctcctgcctcagcctcccaaagtgctgggattataggtgtgagccaccgcacccagccttcaggcctttttatggctaaataatatggtcctgtttcctagagaagaacttgagtttgggggtagaggagagacagggagactccctgagaaagccatggaatgaaagcatgacagaggctgttttccccttagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgaggtaagccccccgggatgctggggtcccatgagggagattgatggcagaacacctgggttccagctccatctgctccccatgtgaaggcaacagggatcaccggatagtcccaaggggtcagctcagaagcaatggttacatgatggcgaagttattcattcaatcttttctttttttttgagacagggtctcgctttgtcgctcaggctggagagtagtggcatcatagtggctcactgcagcctccacttcccgggctccagtgatcctcccacctcagcctcccaagtagctgggactgcaggcacatgccaccatgcccagctaatttttgtatttttggtagagacagggtttcaccacgttgcccaggctggtcttgaaatcctgagttcaagcaatcctcctgcctcagcctcccaaagtgctgggattataggcataagtcaccgtgtctggctgggcacatttctttttttattttattttattttttttgaggcagagtctagctctgtcacccaggctggagtgcagtggcacgatcttagctcactacaacctccacctcccgggttcaagcaattctctgcctcagccccgcaagtagctgggataacaggctcacgccaccaccctggctaatttttgtatttttagtagagatagggtttcaccatatattctttacgtctttaaatcttttatccatatttataaagtgtacacagtaagattttctacctcatataagattattgtaaagatgaaattaagtcctaacacatacaattacttaataagtgttaattattatcattagcaatttatgataaatatatgcaacctattaattaaaagtgcattaaagggcccagcgtggtgactcacagctgtaatcccaacactttagcaggccgaagtggagggattggttgagcccaggagtctgacgctgcagtgagctatgattgtgccactgcactccagcctgggcgacagagtgacaccctgtctcaaaaaaaaaaaaagaaaagtgcattaagctattcattaatgtgcagagcctcttcccagctgcaggtgttcttcccattgacatcagagcttctgcttgtcccttttgggactattatttctttcccctgcctcctttaaccagtctcctgggtctctctgagttgctgctgagattagcttcagccacagcctgggcagaaagatctgtcacaaccattggcaccaagaagctcttccctctgccctaggaggcatgtattcacttttgtttttttttttttgacaaactattcactcacagttctctattgatgcaaaaaccattctagccgtgtttgtttgtctgtttgtttttgagacagagtttcgctcttgttgcccacgctggagtgcaatggtgccatctccgctcactgcaacctccgcttcccaggttcaagcgattctcctgcctcagactccggagtacctgggattacgggcatgcgccaccacgcccagctaattttgtatttttggtagagatggggtttcttcatgttagtaaggctggtcttgaactcccgacctcaggcgatccgcccgcctcagccttccaaagtgttgggattacaggcgtgagccaccgcgcctggctgtattcacttctaatagattcatttatgcattcaacaaatgtttatttagtactttcttcaaaggtgtgtttttttggtttgttttttggggttttttttttggtagagatggggtctggctctgttgcccaggctggtctatgaactcctgggctcaacccatcctcccacctcagcctcccaaagtgctgggattacagtggtgaaccaccacacccagcctacttagtactttctactctgctggcactggggtcgccacgaataggctgtggtccttgccctcataatgccctcagattcagagagacacatggggtcttggtttactccttcattcagcaagtatttactgaatgagagcactcatgggagggctaagatgttgggtaaagacagatattggctgggtgcagtggctcatgcctgtaatcctagcactttgggaggccaaggcgggcggatcacctgaggtcaggagttcgagaccagcctggccaacatggagaaaccaagtctctactaaaaatacaaaaattagccgggcgtcgtggcgggtgcctgtaatcccagctactctggaggctgaggcaggagaatcgcttgaacgctgaaggcggaggttgcagtgagccaagatcacgccacttcactccagcctgggtgacagagtgagactccgtctcaaaaaaaaaaaaaaaaacaaaaaaacagacagacataaggctgggtgcagtggctcacgcctgtaataccagcattttgggaggccaaggcaggagggtcacttgagctcaggaattcaacaccagcctaggcaacacagcaagactccatctctccaaaacgttaaaaaaaaaaaaaaaaaaaagtcgggcatggtggcatgtgcctgtagtcccagatacttgggaggttgaggcaggaggatggtttgagcccagggggtcaaggctgcagtgagccatgattgcgccactgcactccagcttgggcaacagagcaagactccatcacaaataaataaataaataaataaataaataaataaataaataaatgaaaaagaaaggcaaagggagaagtactctaggagctatatgactgtgtgacctcacatccctttctcccagcctggggcagagtggttcagccccaactgcacagaacattgccgctgctggcccggcagtcgggtcgagtgccagatctctcagtgtgggacacacaccgtgtgccagcttaagaatggccagtatggatgccacccctacggtgagagcccctccccatgctgtccctgcctgccagccagttggagtagacgtgacgccaggatcccaatccctcgcttgagcagaggattgggggcctgccaccgggcagcgggtgggccagcatgtgcggtccagcctggaggagccacagaagcagcttcgcctgttctccttccccctcccagcaggcactgccacctgcttggtctacggagaccctcattatgtcacctttgacgggaggcactttggcttcatgggcaagtgcacttacatcttggcccagccctgtggcaactcaacaggtaggccctggagatgccactgcggcctggggggagggtctgtgggcagcgctgctaggcatggggcatggtgggtggcaggaaggggcagggcacagatgggggaagaggcaagataggagcaagttcttctgtaaggtgagggttgaaggccaggcacagtgactcacactggtaacctcagcactttgggaggctgaggcaggaggatcacttgaatccaggagattgagaccagcctaggcaacacagcaggactctcatctccatgaaaaaaaaaattaaaaatcaggccgggctcagtggctcacgcctgtaaccccaacactttgggaagccgaggtggggggttcacctgaggtcaggagtttgagaccagcctggtcaacatggtgaaaccccgtctctactaaaaatataaaaaattagccaggcttggtggcaggcacctgtaatcccagctacttgggaggctgaggcaggagaattgcttgaacctgggaggcggaggttgcagtgagccaagatcgagccactgcactcctgcactctagcctaagcagcaagagcaaaactctgtctcagaaaaaaaaaaaaattaaaaaatcagctgggtatggtgggacacacctatagtcccagctagtcgggaggatgaggcaggaggatcgcttgagcccaagagttggaggctgcagtgagctatgatcacaccactgcactccagcctgggtagcaaagtgagatcttgtctcgaaaaataaataaatacacacataaatgaagttaaaaacaaaaaagcaaagaaggcagtggtagtggttagggagcacagacgccctggaggatgttccagccactgagtggagacagacacgctgcggctgcaggctcttctggaagaggcagtcgtggtctgctcctgtgtggatccggcctcccctactggactttggggctggtgtctcggtggcgctcatctctccctgcggcgccaggctcagggcactgctcgcggcagatgttcagaaatgagccactgggctctcttcattcctctccctacccagacccattcttcagggtgacagccaagaatgaggagcagggacaggaaggcgtgtcctgcctgagcaaagtctacgtgaccctgcccgagagcaccgtcaccctgcttaagggcagacgcactctggtgagccccattccacccccaccatccttgcagggtctgactgtgtgtcctggccaacccttccaatccctgaacctttccacggatggggttcaacaagacagtgacctgcaatcccagctccttgggaggctaaagtgggaggattgcttgaggccaggagtttgaagccagcctgggcaagatagcaagaccctgtctcttaaaaaatagaaaaaattagcctggtgtggtggcacttgcctgttgtcccctctactccagaggctgaggtgggaggattgctggagcctgggaggtcgaggctgcagtgagctgtgattgcaccattgcactccagcctaggcaacatagtaagacactgtctcctaaaaacaaaaacaaaaacaaaacagtggtgaggaagctccagtccactcctggtggatgagattgttaggccgctgtggatggtgtcctgcctcccagctatggaaatgaaagtctgctggggtcctccttgacccccagctctgtctgtctcttgcctctgccctgccttccaggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccaggtaaggcagtgtcccagccaggcagctgccacttcttcctgctgcctcttcctgctgcctcttcttcctgctgcccaccctgcccactccccttccatccctggcaccactacttgatcctttatgcattcacggatgggaagcaccctgcttaagtggcagggatccctttggaccaggagacaggagaaaatggtttcggggcatgtgatagatagcaggatggatgtacatgctttgggaatgtgctagaaggagcactagtgagttctggaggctttctgaagggcagtcacctggtcccattctcgaaggaagagtggctccccagatggacaaaacaagggaaagcaagattcttcttcttcttttttttgagacaggatctctcgctctgttccctaggctggagtgcagtggtgctatctcggctcactgcaacctctgcctcccaggttcagcaattctcctgcctcagcctcccaagtagctgggattacaggcgcacaccaccatgcccagctaatttttgtttttagtagagatgggatttcatcatgttgcccaggcttgtctcgaactcctgacttcaggcgatcctcctgcctcggcctcccaaagtcttggaattacaggggagccactgtgcccggcgaaagaaagactttataaaaatactttatagaggccaggtgcaggggttcccgcctgtagccctgaactttgggaggctgagacgggagaatcccttggggccaggaattccagaccagcctgggcaacatagtgagaccatatctccacaaaaaaatttaaatattagccaggcgtagtggcctgcacctataatctcagcatgctgggaggccgaagcaagaggatcacttgaggccaggagttccagaccagcctggacaacatagtgagatcctgtctcttaaaaaaaaattagcttctcgtggtggtacttgcctgtagtctcagctactcaggaggctgaggtgggagaatcgcttgaacccaggagttggaggctgcagtgagccgagattgcaccactgtgctccagcctgagccacagagggtgaccctatctctaaaataaataaaaaaataaataaataatttggccaggcacggtggctgacacctgtaatcccagcactctgggaggccaaggcaggcagattaggagtttgagaccagcctggccaacatggtgaaaccccatctctactaaaaatacaaaaaaattagctgggcgtggtggtgtgtgcctgtaatcccagctactcggaaggctgaggcaggagaatcactagaacccgggaggtggaggttgcagtgagccgaggttgcaccactgccctctagcctaggtgacggagagagactccatctgaaaaaaaggataaataaataaataaataaataaataaataaataaataaagtgggagtgttttagggccagcaaggggtttgctgtggctggacaatgaacagaggggaaggaggcttgggggagggccatggggtcctcttgtccagtccgcacctcttcatcctcctcacgccctctgttttaggatcccagctccttgccttctctgccactgcccctcgaggaccgaggctgcttctctccattaacgccagctcctctcctgttcccctagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgagcaaggagccctcccaccggggccctgggaaggttccgtccccttcctggaactctcttttttttttttttttttttttttgagatggagtctccttctgtcgcttaggctggagtgcagtggtgcgatctcagctcactgcaacctccgcctcccaggctcaagcaattatcctgcctcagtctcccgagtagctgggattacaggcacctgccaccacacacagctaattttagtatttttgtagagatggggtttcaccatgctggccaggctggtctcaaactcctggcctcaagtgatccacctgccttggcctctcaaagttctgggattacaggtgtgagccaccacaccaccacgtccagccctccacccgccctttttttttttttgagatgggatctccctctgtcttccaagctggagtgcaatggcacgatcgtggcttactgcagcctcaaactcctgagctcaagcaatcctcccttctctgcctcccaagtagcttggactacaccatgcccagctaactttaacaaaattttttggtagacatggggttctcaccagatggggggttgaccaggctgctggccctccccaacggtttttttttttttttttgagatggagtcttgctgtgtcacccaggctagagtgtagttgtgcaatctcagctcactgaaacctctgcctcctgggctcaagtgattctcacgcctcaatcccaatgagattataggcacatgccaccacacctgtctgatttttgtatttttagtagagacggggtttcatcatgttggccaggctggtttcgaactcctgacctcaggtgattcacctgccctggcctcccaaaatgcaaaatgccgggattacaggcatcaccaccacacccagcctgtgccctccctttaaaaaatgactggcattgcccctttctcctctctaccctggagacttcaagttgttctttcagttgctcaatattcttttttgtttgtttgtttgtttgtttttagagacagggccttgctctgtcgcccaggctggagtgcagtggttcaatcacagctcactgcaggctccaactcctgggctcaacagattctctcacctcagcctcctgagtagctggggctatggacgtgcgccatatgaaatatgaaataaataatttcatatttatttttaaagagatgggatctcagtgtgttacccaggctggcctggaactcctgggctcaagcaattctccctgcctcggcctcccacagtgcctggccagggctcagtggtcaaacatcctctgggaggggtttcccagctgacaggctggtttgccggtcccggcctgccagccttgctgcctgctgggttagggatgagctggaagcgagctttgtctttagggagtttggggtgggtctcttgcaggtgtcagaagtaccaggtggtgaattccccgtcttgtgattcatctctgcagagcagcatgtcggggccagggttctgtggacggctggtcgacactcatggcccatttgagtatgaaggagggcaggcagggtcgcacaggggcgatgcttggcacctgggctcctccaaggctctacccccttccactgcattccccctgacttggtcactcccctcaggacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgccgtgagttgtgccaaactcagaggagaggccgggcacggtggctcacacctataatcccagcactttgggagtccgaggcaggtggatcatgagatcaggagtttgggaccagcctggccaacaccccgtctctactaaacataccaaaattagccaggcatggtggcatatgcctgtagtcccagctacactggaggctgaggcaggagaatcgcttgaacccgggaggcagaggttgcagtgagccgagattgcgccactgcactccagcctgggcgacagagtgagactccatctcaaaaaataaaataaaataaataaataaataaataaaaatacagaaattagctgtgtgtggcaacgggtacctgtaatcccagctacttggaggctgaggcaggagaattgcttgaacctgggaggcggaggttgcagtgagccgagattgcaccactgcactccagcctgggtgacagaatgagactccatctcaaaaaataataaaaataataaataaataaatatacaaaaattagctgtgtgtggcaacgggcgcctgtaatcccagctacttgggaggctgaggcaggaaaatcgcttgaacccgggaggtggaggttgcagtaagcagagattgcgccactgcactacagcctgggcagtgagagcgaaactctgtctttaaaaaaaaaaaagtgtttctgtgcagcccaagtcatcacacgcaggcacacggtacaggccctaggcaggggaggcaacgaggctgcctcccagctcctggtgtggcccagctctttggggaagctgctttagggcaggcctatcccctgactcagacctcacaggtggccccggtcccctgcgggccaacagctcacctggggcatgtctacacagcagcgctgccagtggtgggtccatctgctcccaccataggtctatctaagtctctcagggccggcgccttagtgctggccctgcagccccagggagccagccaggctccttggggaagcttctcacagtcactctctcttctcgagattggccagaagcctggagctggggcccttccgaacgtgtccttcctgtttcccacccagccccgtggcttgttcgtctccttctcacccaagcttctccctccaccagcaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtgagcggctgcgtggacctctcagccctgcagctagaaagggcctgctccctgctctcacaccccctgcaagctctttcttttcttttcgtttcttgttttgttttgtttttgagacggagttttgctctgtcgccaggctggagtgcagtggcacgatctcggctcactgcaacttccgcctcctgggttcaagtgattctcctgcctcagcctcccgagtagctgggactacaggcatgcaccaccatgcccagctaattcttgtatttttagtagagacggggtagggggcggtttcaccatgttggccaggatggtcttgatctcttgaccttgtgatctgcccacctgggcctcccaaagtgctgggattacaggcatgagccaccatgcctggcccttgttttttggttttttgttgttgtttttggtttttgttttttttttgagacagagtctcgatctgttgtccgggctggagtgcagtggcacggtctcagctcactgcaacctccgcctcccaggttcaagcgattctcccgcctaagcctcccaagtagctgggattacaggcgtgcactaccacgccaggctaatttttgtatttttagtacagatggggtttctccatgttggccaggctggtctcaaactcctgacctcaagtgatccacccgccttggcctcccaaagtgctgggatcacaggcgtgagccgccacacctggcctcggatagatcaattttggttgaaatgatgaacagacccagaaatgatgtagtgactgaaaaaacgaatggatgccaagcttttgcagcgaatctcggagcttcaggaagagaggatgtctccccactattaagccagtgatctgaacagctctggtgagctctggtgtcagatctgggaaaaaacaaaacaaagcaaaaaaaaacactttctcttccttccctgctgtcttccccaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgagccatcagggtggaaggtgagctgggggctgcccaggcaacaccaggcaaggtgatgggtcctgcccaaagcagcttccccagacagctgagtctccaccagggcctgggaggggcagcaggggcagcattttcagggacccaaagggtgaggttggggacgtcagtgtttctcttaggcagctccaagccaagccaaccacacttcctagggaaacaccacatctgtgggtgggccgtggggaccatgccaatgtgggctctccaggatggcagctctgagtcaaagcttccggggcatggaggagtgagactgtgaactccatcttcttctccacaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatggtgggtgtcttcctcctgcctcctggaccctgaacacccagcctgcttgcttctctcctgtgcccctccttgcccggatgcccacctctctggctccttagagcacctgggaagcacctgcagctgacccagaccctcttctctggactccctcctccctctgtgaaatacccaccagcaccagcccctcctgctcccagttttttgccgttttttttttttttttttttttttttgagacagggtcttgctctatcacccaggctggagtgcagtggtgcgatcatagcttattgtggccttgaccccctgggctcaagtgatcctcccacctcggcctcctaagtagctgcaactataggcatgcaccacctgcacggctaattttttttttcactttttgtagagacgggctttctccatgttgcccaggctgatctcgagatcctgggctcaagcgatcctccgcctcggcctcccaaagtgctgggtttgcaggcatgagcccccgtccttgcctttatcccgagttctttcctgactctcctttctacgtcctccctgcctctgcagctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtggtgagtttcctgggcacctgcggggaaagctgggacaatgagtaggcgtgtgacctggtcccagctcccccaacatctctgtgaggtgttctaagtacttgtcaactgactaattcgttgaggacattaggcatgaaggtaggagttaagggaagacggagatgaagagacagaaaggggccaggcgcggtggctcatacctgtaaatgcaacactttgagagcccgaggagggtggatcacttgaggtcaagggttcgagaccagcctggccaacatggcaaaaacctgtctctactaaaaatacaaaaattagccaggcatggtggtgcatgcctttaatcccagctatttgggaggctgacgcgggagaatcgcttgaacctgggaggtggacgttgcagtgagctgagatcgcgccactgcactccagcctgggtgtcagagcaagactccatctcaaaaaagaagaaaaagagacagaaagggttaaccttgctatgtagaatgaaaagtgagggtgccaggaggatggtggccctggggcctggcctgctggggggccccttcttgcctgttttaatgactccctcctctagggaactacaacaacaacagcttggatgacaacctgcgccccgacagaaagcttgcaggcgattccatgcagctgggggccgcctggaagttacctgaatcctctgaacctgggtgagctgggggtcaggggagccaggcaggaggggctgggcctgggaagggcctcggggggcagcttggaagtgtcctctgtgtgtccccactccctctgtgctgtacctcccaactggcaggaaactggcaatctctcctgtttagactctccaagattggagttggtaagaagctgttctgacttcccacgcccacgcctgctgatttctcccatgcttagtgatctctttggagggcccacttgggaagttcaccctgaggtctagcctttttccttcctgctgcatctccttgccttgctacttgagggcaccgttttgtcctcttctcctgtatccctctctctttccctgtccactttttgttttgttttgttttgttgtttttgagacagagtcacgctctgtcacccaggctggagtgcagtggcacgatctcagctcgctgcaacttccgcctcccaggttcaagtgattatcctgcctcagcctcccaagtagctgggattacaggcactcgccaccacgcccggctaatttttgtatttttatttgagacagcgcttctccgtgttggccaggctagtctcaaactcctgacctcaggtgatctgcctgccttggcctcccaaagtgctgggattacaggtgtgagccactgcacacagccccctgtccacttttgcttcggtttgggagatggttcctcaggccctcaggtcttgtcttgtctttttttttcttttcttttctttcctttcctttccttctcttccctttcttccttcctttcttccttcttcctttcctttcctttcctttttttcttttcttttcttgagacagggtcttgctctgttgcccaggctggagtgcagtggtgcaatcatagctcactgaagcctccaactgctgggctcaagccatcctcccaccacagcctcctgagtagctgggactataggcacatgccaccacgcccggctaatttttaaaaattttgtgtagagataggatctcactatgttgcccaggctggtcttgaacttctggtctcaagcgatcctcctgccttggcttcccaaagtgctgggattataggcatgagccactgcacccaacctgtagccctcagtttctattctctctcatttagctgtttccttgtgggtggcaagccctccagctgccaggagaacagcatggcagacgcctggaacaagaactgtgcgatcttaataaaccctcagggtaagacatgtccctgctggccctttttcctccctgaaggacaggaggctggggagggagtctagtcagggagggagaaacaacaagaccagaaacagatggaaaagcatgaggaaggcaaatgggaacacagggccagccagcagtcaccttcttgggacctatgactgatgggtctgtatttgtgtctcaggcagtagataaatccgggatttctttttttttttcctattaaaaatgttttaataggctgggcgcagtggctcatgcctgtaatcccagtactttgggaggccgaggagggcagatcccgaggtcaggagttcgagaccagcctggctagcatggtgaaaccccgtctctactaaaaatacaaaaaattagctgggcctggtgacgggcacctgtagtcccagctacttgggaggctgaggcagaagaatcgctttaacctgggaggcagaggttgcagtgagccgagatttcgccactgcactccagcctgggcgacagagtgagactctgtctcaaaaaaaaaaaaaaaaaagtttaatagagatgggggagtctcactatgtagcccaggctgttctcgaactatggaccccaagggatcctcccccttggcctcccaagtagttgggatgacaggcataagccaccacgcctggccgttttttcttttttcttgttttttagagacaaggtctcactctgttgcccaggctggagtgcagtggcacgatcacagctcactgcaggcttgaactcctgggctcaagtaatcctcccgcctcagccttcagagtagctgggaccacaggcatgcaccaccatgcccaactaattttttttttctcactctgttgcccaggctggagtgcaatggtgtgatctcagctcactgcaacctctgcctcccaggcgcaagctattttcccacctcagcttcccaagtagctgggattacaggcctgtgccaccacacccggctagtttttgtatctttagtagagacaacatttcaccatgttggccaggctgatcttgaactcctgacctcaaatgatccacctgccttggcctcccaaagtgctggtattaaaggcatgagccatcatgcctggcctaatttttaaatattttctggagatgaggtcttgctatgcagcccaggctggtcttgaactcctgggctcaagtgattctcctgctttgccctcctaaagtgctgaggttataggcgggagccaccacacaaatctgggttttgtttgtttgttttgtttatattctctgttacccaggttggagtgcaatggcacaatcatagctcatcctcctgcctcagcctgctgagtagctgggactacaggtgtgcaccaccatggccggctaatttttgtacagacacagtttcactgtattgctcaggctggaaaatccaggaggttttttttttgttttttttttttgagacggagtcttgatctgttgcccaggctggagtgcaatggcacaatctcagctcactgccacctttgcctcctgggttcaagagattctcctgccccaacctcccgagttgcctggactacaggtgccctctactatgccctgctaatttttgtatttttagtagagattgggtttcaccatgatggtcaggctggtctcaaactcctgacctcaagtgatctgcccacctcggcctcccaaagtgctgggattacaggtgtgagccactgtgcctggcgggaaaatccaggttttgactgaagtggatgtcgaatcagccccagggaagccacatggccctgttccttcccggcccctcccctggctcatctgccttctctcttcctgcaggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccgtgagtgactggccacctgttcccacagcccataggcaccctccagaattctgccctccctttcttcctctaaattcttttttttttttttgagacggagtctcactctgttgcccaggctggagtgcagtggcgcaatctcggctcactgcaacctctacctcctgtgttcaagccaagatgggtgaatcacctgaggtcaggagttggagaccagcctggtcaacatggtgaaaccccgtctctattaaaaatacaaaacttggccaggtgtggtggcaagcacctgtaatcagctactcaagaggctgaggtgggagaatcgcttgaacctgggaggcagaggttgcagtgagccgagatcacaccactgcactccagcctgggcaacaagagtgaaacaaaaaacaagagtgaaaaacaaaacaaaacaaaaagttctggcagtagatggtggtaatggcagcacgacaatgtgactgtacttagtgctgttgaagtgtacatttaaaaaattgttgccgggcgcggtggctcatgcctgtaatcccagcactttgggaggccgaggcaggtggatcacgaggtcaggagatcgagaccatcctggctaacacggagaaaccccgtctctaccaaaaatacaaaaaattagccaggcgtggtggtgggcgcctgtagtcccagctactcgggaggctgaagcaggagaatggcgtgaatctgggaggtggagcttgcagtgacccaagatcatgccactgcactccagcctgggcgacagagcgagactgtctacaagaaaaaaaaaattgttaaaattgtagattttatgtctgttttttttttgtttgtttttttttttttttgcttttgagagtctcgctgtcgcccaggctggagtgcagtggtctgacctcgcctcattgcaacctctgcctctcaggttcaagagattctcgtgtctcagccacccaagtagctgggactacaggcgtgtgccaccccaagtagctgggactacaggcgtgtgccaccacgcctggctaatttttgtatttttagtagagtcggtttttcaccatgttggccagcctgttctcgaactcctgacctcaggtgatccacctgcctcggcctcccaaagtgctgggattacatgtgcgagctaccgctcctggccactactaggagcttttgatgccccaaggtttgggggctggacatgccaccccactcttcctaatgctctcattttctttagctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtgagaggccagctaggaggggccccgccctttccaggcccacatgtttggggtcagggcaagctcaggagaggcaggaggaaggctcagaacctgggaggggcagggctggccaaggctggggggcgaggaggaagggcagatgctgcacccagcttcaactggggcgttggcccatctcccaattccaactttctgttggctcagctgatccctgtggcccacaggtcggggagcgctggtacacagagaacacctgcaccaggctctgcacctgctccgtccacaacaacatcacctgcttccagagcacctgcaaacccaaccagatatgctgggccctggatgggctgctccgtttcgggcctcaggtaggaggaccacggtgatggggggactccacagccctgaggcccactctcccaactccccaacagactccctgctgcctgtagcactgggtttcaggttttgactggtaactctgctgcaaccaagagcttctggtgggtaagatgacctccaactgctgagaagggaaccttggggctcacccatccttctcctgtagcggccaccaacttagatgggatattataaatccttccctggggccagacgccatggctcacacttgtaatctcagcactttggaaggccaaggcgggtggatcacttgagaccagaagttcaagaccagcctgaccaacatggctaaaccccgtctctactaaaaatacaaaaattagcctataatcccagctactcgagaggctgaggcaggagaattgcttgaacccaggaggcagaggttgcagtgagcagagatcgtgccattgcactccagcctgggcgacaaaactccgtctctaaataaataaatcttttcctggaggccaggcatggtggctcatgcctgtaatcccagtggtttgggaagctgaagtgggagaatcacttgaggctagtagttcaagaccagcctgggcaacatagtgagaccccatctctacaaaaaaataaaagctaaaaagttaaaaagtaaaattaaagacattgcacctgtagtccctgctacttgggaggctgaggtaggaggatctcttgagcccaggaattagagtctgcatgccagcctgggtaacagaacaagaccctgtctctaaaaaaaattttttttaattagttgaatagggtactttatgcctgtagtcccagatactctggaggctgaggtaggaggaccacttgagcccaggagtttgaggctgcagtgagctatgaccatatgccattgcattccagcctgggtgacagagagagaccatgtctcaaataaaaaaaaaaaaaatccttcctccaaagaatcatgcccctcctccacccgtaaacctcaccacgcctcctagccctggccctggggttttttgtttgtttgtttgtttgtttgtttttgatgcagtgtctctgttgcctgggctggagtgcagtggtgcaatctcggctcactgcaacctccatctccctggttcaagcgattctcctgcctcagccttccaagtagctgagattacaggcacacgtcaccacaccctaatttttttgtattttttttagtagagacgggtttttaccatgttggtcaggctggtatcaaaccagcccaccttggcctcccaaagtgctgggattacaggcatgagccactgcgcacagccggacctggggtcttgactcttttctggaaggcagggagaacccaggactagtttcccagggaccctgtacctgccagaggagcgtcatagcccagctgtctctctgtcctcccaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctagtgagctgggtgtggtgaccggggctgggagggagtgctggggaggggactcttgtccctgctcctactcaccgtcactgtcctcctgtttagatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtgaggaaaacatctggctcttctcgctggggaggcagccccagggagattggtggccggcagggatggggggcagtgttcgcatcgtgcctgcccaaagaggccactcctcaggatggagcagggcagtggaggagtgcgcctttctgtgtagggtggacaagagtgtttccaggaaaaaacaggaaaaaccattctgcccgggcatggtggctcatgcctgtaatctcagcactctgggaggccgaggcaggtgggtcacctgaggtcaggaggtcgagaccagcctggccaacatggtgaaaccccgtctctattaaaaataaaaaaaaaaattagttgggggtggtggtgcccacctgtaatcccagctgctcgggaggctgaggcaggagggttgcttgaacctgggaggcggatagtgaagtgagctgagatcatgccactgcactccaggctgggtgacaagagtgaaacttgaaggaagggagggagggagggagggagggaggaaaactgctctcgtgagggaaggaaagaaggaaggaagggagaaaaactgttctcgtgcttccccagcaccgaaaaaccactctcccccgccaggtctgcggcatgtgtgggaacttcaatgatgaggaagaggacgaactaatgatgcccagcgatgaagtagcaaatagtgacagtgaatttgtgaacagttggaaagataaggacattgacccaaggtagtggtcccctaagaccctctaggttttctttctttttctttctttgtctttctttctttctgccttcccttcccttccctcccctcccctcccctccccttccttcctttcttcctttctctctttctctttcttttcttcctctcctttctttttttttttttttttttttttttgagacggagtcttgctctgtcgcccaggccggactgcggactgcagtggcgcaatctcggctcactgcaagctctgcttcccgggttcacgccattctcctgcctcagcctcccgagtagctgggactacaggcgcccgccaccgcgcccggctaattttttgtatttttagtagagacggggtttcaccttgttagccaggatggtctcgatcttctgacctcgtgatccacccgcctcggcctcccaaagtgctgggattacaggcgtgagccaccgcgcccggcccctctcctttctttcgttctttttttttctgagacagaatcttgctctgtcacccaggctggagtgcagtggtatgatctcggctcactgcaacctccgcctcccgggctcaagtgatactcctgcctcagcctcccaagtagctgggattacaggcacccgccaccacgcctggctactttttgtagtttttagcagagacggggtttcaccatattggccaggctggtctcgagctcctgacctcaggcaatgtggccgccttggcctcccgaagtgctgggtaatcatgagcgactgcacctggaccctctagcttttctttttttctttttctttttgagatggagttttgctctgtcacccaggctggagtgcagtggcgcaatcttggctcactgcaacctctgcttccggggttcaagcaattctcgtgcctcaacctcccgagtagctgggattacaggtgcacaccaccacgccccacgtctggctaatttgtgtattttaggtagagacggagtttcatcatgttggtcaggctggccttgaactcctgacctcaagtgatccgccccactcagcctcccaaagtgctaggattacaggcatgagccactgtgcctggccacccctccagcttttcatagcaacatgagctagggagccagactgtagggcacacctggggcaggaagaccagaatgttccttttttcttcttcaatttttaaattttttgtagagacagggtcttgccacttttgcccaggctggtctcaaactcctgggctcaaatgatcctcccgcctcggccccccaaagtgctgggattacaggccagaatgttgctttgtgtgtgtgatttgagggcgatgacttctgggcattctggggcgatgtgtgtaattgatccatctcaaggctgctagaacccacttgaggaaatgtgaaagcttcctttcctcgcttagaaaccttggaggaggagcaggagcagaggctcatgcctgtgattccagcactttgggaggccaagactggaggatcacttgaggccaggagtttgagaccagcctaggcagcatagcaagaccccatctttacaaaaaaattaaaaacaaaaattagccagccatggtggcacatgcctgtagtcccagctatttgggaggcttcagcaggaagattggttgagtccgagatttgaaggctacagtgagctatgattgcatcactgcactccagcctggatgacagagcaagatgctgtcttaaaaagtttaaaaacagccgggtgcagtggctcacgcctctaatcccaacacttcgtgaggccaatgtgggaggattgcttgagcctaggagtttgagaccagcctgggcaacatagcaagacctcatctctacagaaaaaaaaaaaaaagaaaagaaagaaaaataaccaggtgtggttagtcccagctactcacaaggctgaggtgggacgatcccttgggcctgggagattgaagttgcagtgagccttgatcacaccactgtactccagactgggcgacagattgggaagcaaaaaaggaaatctgagagaagacgaggccgatggaagattggccagagctcagaccagcttccctgtgaacaccagaagggttaggagggtggggaatccctgagaggtctctctgggtcatttgggagcaccagatcattgtcatagggccaggcgtggtggctcaggcctgatatctcagcacttcgcgaggccgaggcgggtggatcacttgaggccaggagttcaagaccagccttgccaacatggtgaaacctcgtctctattaaaaatacaaaaactagccggtcatggtggcgggtgcctgtaatcccagctactcaaaaggctaaggcaggagaatcgctttaacctgagacgtagaggttgcagtgagccaagatcacaccactgaactccagcctgggcgatacagtgggaccttgtctccagataaaccaaaaccaaaaattagctaggcatggtgccgggtggctgtaatcccggctactcgggaggctgaggcaggagaatcgcttgaacccgggaggcggaggtctcagtgagccaagattgcactactgcactccagcctgggtgacagagtgagactctgtctccaaaaaaaaaaaaaaaattggtcgggcgtggtggtgggtgcctgtagtctcagcaactcggaaggctgagtgagacaggagaatcgcttgaacatgggagggaaggcagaggttgcagtgagctgagactgttgcattgcactccagcctgggtgacagagcaagactccccctaaagaaaaaaaaattttgtgtcatagtagggggacggctgtccctaggctgattcttttcccttcccagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccgtgagtgtgccctgctgtcaccccaaacccctcccaaaccccctttccctctctgcttccctgagagctccctcactctccttcctgttcgttcctgactaactcagccctcattgtttctttgacaaggactattttttaatttttatataaaattttttttgctgggtgtggtggctcacgcctataatcccagcacttggggaggccaaggtgggtggatcacctgaggtcaggagttcgagaccagcctggccaacatggtgaaaccccatcctactaaaaatacaaaattagccgggtgtggtggcacatgcctgtaatcccagctactcgggaggctgaggcaggagaattgcttgaacctgggaggcggaggttgtagtgagccgagatcgcgccgttgcactccagcctgggcaaaaagagcaacactccatctcaaaaaaaaaaaaaagtgtcttttagtatcttgataaagttgtgcaaccatcactactatataacgccagaaacttttacaatttaaaacaggaattcaatagagttttttttaataggtaacacatttgcaggattcaaaaacgtataaagtattaaaaaatttaaaatacttttaaagtattaaaagatacccagtaggttgggtgtgatggctcatgcctataatctcagcaatttgggaggctgaggtgggtggattgcttgaaaccaggagttcgagaccagcctgggcaacatagtgagacccaatctctacaaaaaattaccaaactagctgggtatggtggtgcatgcctgtggtcccagctacttgtgggggtgaggtgggaggatcacttgagcccggcagtgaactgtgattgcatccctgcactcaagtctgggtgacagagtgagactctcagaaaaaaaaaaattctccccaaaaaacaaaaaaagataccagtgtaccgtctccctcccaccctcaccccatgggcctggttcatgtctcagtatttttcccaagaccacttatttatgcatatataaacaaattcaaatttatattcgtggctgggtgcagtgactgacacccgtaatccaagcactttgggagtccaagaagggaggattgcttgaggccaggagtttgagaccaacctgggcaatataatgagacccccgcatcgctacaaaaaaattaaaaaaacaaaagacaagaaaactatatgctctgtgcttttggagttttgccaatctgagaattgaaaaacaacgtcttattatttttttgccagtgtttcataagaaggtttattttatttatttttttattttatatatattttttgagacagaatctcgctctgtcaccaggctggagtgcagtggtgtgaccttggctcactgcaacttccaccttctgggttcaagagattctcctgcctcagcctcccaagtagctgggactgcaggcacgcaccaccacacccaggtaatttttgtatttttagtagagacagggtttcaccatgttggccaggttggtctcgatctcttgaccttgtgatctgcctgccttggcctcccaaagtgctgggattacagacgtgagacatctcaaccggccaagaaagtttatttttctttaaaacactctcgcgttccaggagcaaagcagaggtgcagggggtgctgcagagcttctcagggccagtggaggcaacatgagcacagcagcctgagctggctgaagggtcagggtgaaagcagcacacaggtcccgtgcagaagggggccgctgctcagctgccccacagctgctgggcatcactgtgggtccagtgtgaccagatcctctgatttttttttttgaaagaagctataagcctgagtttttatttgacattgctatacttttttttttttttttttgagtctcactttgtagctcaggctggagtctatgatctcggctcactgtgacctctgcctcccaggttccagtgaatctcctgcctcagcctccgagtagctgggattactggcatgtgccaccacacccagctaatttttgtatttttagtagagacggggtttcaccatattggccaggctggtcttgaactcctcacctcaggtgatccacctgcctcaagcctcccaaagtgctaggattacaggcatgagccactgcacctggtcatgaaaaataacaagacttaatttgagtttttattatgagtgagattggacattttttcatgtacttaggaaccctttgaatttccctttctgtaaactatctgctcttatccagtcaccatttttccattgagtcgttggtctttactgaactatttcatggaagtcctttatctgttatggaaagtagacctttattagtgctctgagttacacaaagttttccagtcctttttgttttcatcttttgactttttttttttttgccatgcaggacaaaaatttttatggggtcaaatatattaatcttgttttatgtcttctgcatcttgagcaatagctataaatgctagccccacagaagctacaaaagagtttgctgattctttgctctagaaattttgtttgtttgagacagagtctcactctgtggcccaggctgcagtggcacgatcccggatcactgcaacctctgcctcctgggttcaagcgattctcctgcctcagccttccgagtagctgggattacaggcacccaccaccatgcctggataatttttttgtatttttagtagagatggggtttcaccatgttggccaggctggtctcaaactcctggcctcaagtgatctgcccgcctcgtcctccccaagtgctggggttacaggcgtgagccaccgtgtccggcctgctctagaacttttatggtttcatttttttatatttaagtgggttttttttgtgtgtgtgtgtgtgtgtgtatttaagtttttgacccatgaagatttatcctgatgtgtaaaatgaggtatgaatcaactttgtttttgtttttctccagaaggctagccagctgttccaatattattaaatgactagtctgtctttgcgcagggactgagataccacaatttatcatatactaaattcccatatatatttggatccatatctgagctttctcctctgttctgtcggtccatctgtatttgcatgtagcagtaacacaaagtcgtaatcactgaaaatttaaaatgagctttgggctgggcgctgtggcttacgcctgtaatcccagcactttgggaggccgaggtgggcggatcacctgaggtcaggagtttgagaccagcctggccaacatggcaaaaccccatctctactaaaaatacaaaaaatagctgggcgtgctagtatgtgcctgtaatcccagctactcaggaggctgagaaaggagaattgcttgaacctgggaggtggaggttgcagtgagctgagattgtgccattgcactccagccagggcggaaagagcgaaactctatctcaaaaaaataaataaatgaataaataaaataaaacaaaataaacgacttatggagggccattcactactgatggctcttttttttagggagttcctggcttttctggtttgcttatgtcttcagctcaactttgaaatcatcttgtcctattaaaagcacacacatatataaaatacttttggtggctgggtgtggtggctcatgcctgtaatcctagcactttgggaggccaaggtgggaggatcacctgaggtcaggagtttgagaccagcctggccaacatggtgaaaccccatctctactaaaaatacaaaaattagccaggcatggtggcacatgcctgtaatcccagctacctgggaggctgaagtaggagaatctctggaaccagggaggcagaggctgcagtgagccaagatcattcctgggtgtcagagagagactccgtccctgcccgtcccccgcaaaaaaaaaaaaaaaaaaaaaaaaaaaaaaatatatatatatatatatatacacatatatatatatacacacatatatatatacatatatatatatgtatattttattgagatcacattaaatgtgtacattcactgaggcagaactaacatcaccatgttgctgaaccttcttatccatgaacatggtatgcatttccatttgttcacactatttttgcttaagggcctttctttaactcccccaacagaattaatacctccctgctctgtgcctccatcatgccttgtatgctcttgctgtcaacacacctactgatcatacacatcaaggtcctgctgccgttgctgtttgaccaccgtccttcatgctggcttgggagagccattcttgttcctttttttttttttttttttgagacagtctcactctgttgcccaggctggagtgcagtggtgtgatcttggctcaatgcaacctctgcctcccaggttcaagtgattctcctgcctcagcctcctgagtagctgggactacaggcgcccaccaccacgcttggctaattgttgtatttttagtagagatggggtttcaccatgatggccaggatggtctcgatctcctgaccttgtgatccacccacctcagcctcccaaagtgctgggattacaggcgtgagccaccatgcccagccgctttttccttgctttcccccaaagcctggcacataacccatactcagtaaatgtttgctgaatgaataacaaaagaacaaaaaaagctccccaagccttgttggtcatccacccatagcttggtttgtacagcccctgcccaccttggccccctgtgaccctctccactgacccactgtctccttcacccacagctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctgtgagtgggcatgggaaatgggactggaggcaacacagcttgagggcagtgctttctccttttctctgcctctctcagcctgggatacccatgacttacagctggcccgggggtgtgaaggctggtgtgagtggcacattgatctccagccaggtctgggctgatggcacatggtttgggttttggatctgaggaatccaaacaagcagcacatggcatggtatagtggaaagaccatgggctcatttcagcctaacctaggattgaatcctgatggtgccactgatgagtcagatgacctctgttatatccgtttcctcatctgtaaaatgggttcagtagtacctcctgcacaacatatgtaagtcaccaagcacaaacacagtgccttttttttttttttttttttttgagacggagtctccctctattatccagcaggctagagtgcagtggcataatctctgcgcactgcaatctctgcctcctgggttcaagccattctcctgcctcagtctcctgtgtagctgggattacaggcaagcgccaccacagcctgctaatttttgaatttttagtagagattgggtttcaccatgttggccaggctggtctcgaactcctgacctcaagtgatctgcccgccttggcctcccaaagtactaagattacaggtgtgagccaccacacttggcctgcacagttgtcttttggatgaccaaatgacactgtggctgcctctggccagcatcaattaagccatttagatggtgggccaggctgctggggcaagaggaaggagaactggccctcccctcttcactcttttttttttttttcttgagacagagtctcgctctgttgcccaggctggaatgcagtggtgcgatcttggctcactgcaacctctgcctcctgggttcaagcaattctcctgcctcagcctcttgagtagctgggattacaagtgtgtgctaccacacctggctaatttttgtatttttagtagagacagggtttcaccatgttggctgggctcgtcacaaactcctgacctcaggtgatccacccgtctcggcctcccaaagtgttgggattacaggcgtgagccgccgcgcccagccccctcctcactctctttctcttcctgtaacttctacagctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacagtaaggggagcgaccggggaggttggagaggggagcacctgtggccagggcggaggtggaggaagaggcagggtgggaaggggcttagcctgaaccccagcacagtcaggggttggggcgggcgactggatcaggaggcctggcctccagtttagctcttgctaactctgtggccatgtgccaggtcctgatcccctctgggaccctccacctgcagggcaaaaagaggggactggtcaaggagatcctccaaagtttttcttttcttgtttgtttgttttttgagatagggtcttgctctgttgcccaggctggagtgcactggcaccatcatatagctagctgcaacctcaaatgcctgcaatcatgtgatcctcacatctcagcctcccaagtagctgggactacaggcatggaccaccacacccagccaattttgctattttttttctagagatggggtcttgctatgttgcccaagatgggcttgaactcatgggctcatgtgttcctcctgcctcagcctcctaaagtgttgggattacaggcatgagccactgtgcccgccccctctaaggtttttaatcaggccaggagatagagaaaattgaagatcaaggatccagggaggctgggcatggtggttcatgcctgtaatcccagtacttgggaggcagaggtggaagaatcacttcagcccaggaatttaacaccaacctggccaacataggaagaccctgtccctacaaaaaattttaaaattttaaaaaattagttaggtgtagtggcttgtgcctgtagtcccagctactcaggagactgacgcaggagaattgcttgagctcaggagtttgaggctgcagtgagctatgattgtaccactgcactccagcctgggacacagagtgagatcttgtctcaaaaaaataaaaaaataaaaataataataaagggcctctaattgaatgtcagtaggtattgaaaaaaaaaagtctaggtaccgggcttggtggcttatgcctgtaatctcagcactttggactttgggaggccaaggtgggaggatttcttgaggccaggagttcaagaccagcctgggcaatgtagtgtggccatttctaaaaaaaaaagaaaaaaattagctaggggtggtggtgcgcacctaaagtcccagctactcaggaggatcactcgagaccaggaggtggaggctgcagtgagctatgatcgtaccacttgtactccagtctgggtgacagaataagaccctgtctcaaaaaaagaaaaagaaaattaaaaaaagaaaagaaaggatccagggagcctgagcctaagagggtggccacaggggatgccaccgtgggggagggactctggggactgtcacacctgggcagggtcccttctcagtcttttgttttgttttttgtttttttgagatggtgtcttactctgtctcccaggctggagtgcagtggcgcgatctcggcgctcactacaacctctgcctcccgggttcaagcaattctcttgcctcagcctaccaagtagctgggattacaggcacgcaccaccacacctggctaatttttgtatttttagtagagacagggtttcaccatgttggccaggctggtctcaaactcctgacctcaggtcatccacccgccttggcctcccaaagtcctgggattacaggcgtgagccactgcgcccggccccttctcactgtctgacttcttggcagagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtaagagctgggccagggcctggtgggtgtggggaggcagctggaccaggtaggccacctggagtagaagtcagggatccctgttccctgggatgtttgtggcaggggtgggctggttgtaaaatcagagtcagcaggacgcagtggttcacgcctgtaatctcagctactcaggaggctaagacgggaggatcacttgagcccaggagttcaagaccagcctgggcaacatagcaagacgcaacatctctgcaaaaaatttaaaatgagctggatatgggggcgcacacctgtagttccagctattgggcaggcttaggctggaggatcacttgagcccaggagtttgaggctgcagtgagccaagatcttgccactgcactttagcctgggtgacagagagaaactgtctcaaaatcaaaaacaaattcagcaacaagctcacttcatgtggggaggcagcagaggctggcaagaaacaagaggaagagaggaggaggacagagcgtgaggtgtgtgaaggtcaatcctgggctgaagaaccaatggcatccactacaccaatgtatttttattttttgaggcagagtttcactctgtcgcccaggctggagtgcagtggcaccatctaggctcactgcaacctccacctcccaggttcaagtgattatcctgcctcaacctccctagtagctgggactacaggtgtgcaccaccatgtctggctaatttttgtatttttagtagagacgtggtttccccatgttggccaggctggtctggaactcctgacctcaagtgatccgcccgactcggcctcccaaagtgctagaattacaggtgtgagccactgtgcccggcctcactgagccaattttttgcaaggaaggacttgggctgggaagggggcggacctcacagaggtttctgccacgtgaatagcaaagcccattggggtatcttattccactctctgcacggagacatatggagatgactgggaaaagtgaagcccagccaggaaatggcagcaggtcaggaggattcagccctgtctgtggctcctgtcttccctctttaggtcaacaaccagaagatggccgtcccctacaggccaaatgaacacctgcgggtcaccctgtggggccaacggctctacctggtcaccgactttgagctggtcgtcagctttggtggaaggaaaaatgcaggtaatggagagaggggaaagaagagcaaaagggccatttctgggaagtgggagggaaaatcctatttaagacaggcaaatcctggtgagcagactcggcccggtagtggggcacccagcttcagaggaggaccaggaggaggtgaggtgagaccaggtggagagcagagggcagagtcttggctgggtgctgtggcactggccagaaatcccagcgctccgggaagctgaggtgggaggatcgcttgaggtcagaagctcaagaccagcctggggaacatagtgagacccccgtctctacaaaaaaaattttaaaggccgtgcacagtggctcacgcctgtaatcccagcactttgggaggctgaggcaggtggatcacctaaggtcaggagttcaagaccagcctggcaaacatggcgaaaccccatctctactaaaaatacaaaaattagctgggtgtggtggtgggcgcctgtaatcccagctacttgggatgctgaggcaggagaatcgcttgaacgtgggaggcggaggttgcagtgagctgagatcgtgccactgcactccagcctgggtgacaagagcaaaactccatctcaaaaaaaattttttttttttaaatgagacaggtgtgatggtgcatgcctgtaatcccagcttctggaactggagaggctgagacgggaggatcgcttgaggccaggcattcgagaccagcctgggcaacatagcaagatcccatctctataaaaaataaaaataaaaaattagctggatgtggtggtgcacacctgtaatcccagctactggaaaggccgaggagagaggatcgcttgagcccagaagttggaggctgcagtgagccatgattgagccactgtactccagactgggcaacagagcaagaccctgctttaaaaaaaagttaattaaggctgggcacggtggctcacacctgtaatcccagcactttgggaggccgaggcaggcagatcacgaggtcaggagatcgagaccatcctggctaacacggtgagaccctgtctctactgaaaatactaaaaattagccaggtgtgttggcgggcacctatagtcccagctactcgtgaggctgaggcaggagaatggagtgaacctgggaggcggagcttgcagtgagcggagatcacaccgctgcactccagcctgggcaacggagcgagactccatctcaaaaaaaaaaaaaaaaagttaattaaaaaaaagagtgagggctaggcgcggtggctcatgcctgtaatcccagcactctgagaggccgaggtaggcagatcacttgaggtcaggaattctagaccagtttggccaacatggtgaaacactgtctctactaaaaatacaaaaattagccaggcatggtggtgtgtgcctgtagttccagctactcgggaggctgagccatgggaattgcttgaaaccaggaggcggaggttgcagtgagccaagatcacacaactgcactccagcctgggcaacagagcaagactgtctaaaaaaaaaaaaaaaaaaaagagtgaggagtctcacttctggggacccccttcctcccgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccaggtgcacggcctggaagggatgaggcgggggaggtgaacaacaatgtctgtgcacggtggccgctagccctcctgtcctcaggagaggatgaaactccagggagagggtgcagataggcctggatcctcccaattccgtcattccctctcatctgactctgggggctcccgctcaatggaaatctctctctgtgcccctgccctgccctcagcctgccttcccagttatttttccttcttccttcttccttctttcctcctcctcctcttcctcctccttctcctcctcctcctccttcttcttctcctcctcctacttcttcttcctctgtcacccaggctggagtgcagtggcatgatctcagctcactgcaacctctgcctcccagtttcaagtgattctcgtgcctcagcctcccaagtagctgggactacaggcatgggccaccacgctcagctaatgttcgtatttttagtagagacagggtttcaccatgttggccatactggtctcgaactcctgacctcaagggatctgcccacctaggcctcccaaagtgctgggattacaggtgtgagccaccacacccagccccagtagttcttatttctttttttaaaatatattttttagagaccgggtcgtgctctgttacccaggctggagtgcagtggcgtgatcttggctcactgcagtttccacctcctgggctcaagtcatcctcctgcctcagcctcccgggtagctgggactccaggcagccaccaccatgcccggctaatcagttcttcttcttcccccacttcaccttccttggggcctcacctgaccccgtggctgtctctactgcagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagtgagtcatgggcccaggacttgtgggaatggcccaggtgcctgctctggtctttccctggggcctcctgcccgcttcctgacccaagctctgtgtggttcactcctccgttctccctgtggcctaatttccttgtgaccctcactggacaccgactgatgtctttctgtttggggttccaggctctcttctgcaggggtgggtctcctcccctccccaaactgactgtgcccttcctgccccctctctgcaccaggcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcggtgaggtgttgcccctccctgtgccgaccctgacccctctgccgtccacctctgctgaacgctcttcccaccattgcctcatctcgggctttctgtcttagtcccatcatccctcgaatttctgccttagtcccaggtccaagtcagcacaaccggcagcctggctccttctctgcccctgcctgggagcctcccaaccccatcccgcatcccgctccttcctgccaaggtccaccttcgctcaaccagttccttcaaatgttctaatgttgcagaccctggatgggctgggcgtggtggttcacacctgtaatcccagtgctttgggaggttgaggctggaggatggcttgagcccaggagttccagccaggctgcagtgaaccatgaccgcacaccaccacactccagcctgggcaacagagcaacatcctatctcaaaaaaaaaaaaaaagaaagaaagaaagaaagaacgaaaaaaagaaagaaattaaaaaaagaaaagactagacaggctggacatggtagctcatacctgtagttccaccactttgggaggcagaggcaggaggatcaattgaatccaagagtttgagaccggcctggggaaccagtgagaccccatctctataaaaatcttaacaaattggccgggtgtggtggtgcatgcctgtaactccagtcaccagggaggctgaggtgggaggatcattggaacccaggagttggaggctgcagtgagccgtgatcacgccagcctgggcactccagcctgggcaacagagtgactccatctctaaaaaaaatttaaaaaaataaaaaataaaaaaaagaccctagatgaagctgcaacacgttctagcttcctgcctatatgcaacgctgagtgtttttgtttttgttgttgttgtctgagacagagttcgctttttgttgcccagactggagtgcagtggcatgatctcggctcactgcaacctccgcctcctgggttcaagcgattcttgtctcagcctcccgagtagctggtattacaggtgcccgccaccacgcccggctcatttttgtatttttagcagagatggggtttcaccatgttggccaggctggtcttgaactcctgacttcaggtgatccacctgcctcatcctcccaaagtgctgggatttcaggtgtgagccactgtgcccagcctactctgagttttatcgggtgaccttgcccctgtttggcctgcccagccccagccagtttctgaccatgactgtccccgcagccatggagtgtccagcaggtaccatatatcagagctgtatgacaccctgcccagcatcctgtgccaacctggcagaccccggggactgcgagggcccctgcgtggaaggctgcgccagcatcccaggctatgcctacagtggcacccagagcctcccctggctgactgtggctgcaccagcaatggcatctactaccaggtctgagctggcagcaggaggccctggggagcagaggcgccaaggagagccagaccagggatggaactggaacgtctcctcctggcccttcccctttctagctgggcagcagctttctgactgaggactgctctcagcggtgcacctgtgccagctcacggatcctgctgtgtgagcccttcagctgcagagcgggggaggtctgcaccctggggaaccacacccaaggctgctttccaggtgaacctgcactcctgcccggttccaagctgccccatgccctggggcgtccatggaccaaggatcgtcccctccttgtcctcaggactcttccacattgatttcaggatgtctgtccctgcctttgtagggagggacaaaggacaaagatctcccgatccctaagcatccatgacctaccgaatccttccctagcgttccttcccatgatctccttcagccctgatggttagcacagcactcctaatttatacataacaaacatggagttcagagaggttaagcagtttcctgctgggcgtgggtgactcatgcctgtaatcccagcatttttggaggtgaggtgggcgaattgctttgagctcaggagttcaagatcagcctgggcaatatagggagacatcgtctctactaaaaattaaagaaaaaaagagctgagtgtggtggtgcactcctgtagtctcagctacttggaagctgaggtgggaagatcacttaagcccaagaaattgaggctacagtgagctataattgtgccactgcactccagcctgggtgacagagtgagatcttgtctcaaaaaagaagagaagagaagggaggaggggagggcaggggaggggaggaaaggaagggagggaggagaggggagaggagaggaagggagaggaggggagaaggagggaaggagagaaggagggaggaaaggaggaagaaaggaagagaggaaggaagagatgaaagagtttcaaaggaaggaagtttccccaaagcccagggctagtgaggcagggttgggagccaggctggctgacccctggccagtctctggcagccgctgctttctccccgggcgtcccagcccccagccaggccttccctcagctgggagtgtcctcccagggcccccctcccacaaccctctctgtccttgcagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccaggtgagggcatcgtccaaggccctgtaccctcacaacctcttcctggccgacaaccacagaatgattctatatgtattatattcacatatagaatgatatgtattataatattatgttacagatattatatattataaacataacaatttgtagctataatggatattaatatattaatatatcttgtatattaattatctatttatatattacatatattattatagtaggaattataatataatccctagaaattcgcaggacaagcatcctcaaaaaaccagtcctggccgggaatggtggctcacgcctgtaatcccagcactttgggaggctgaggtgggcggatcacgaggtcaggagatggagaccattctggctaacgaagtgaaaccccgtctctactaaaaatacaaaaagttagccgggtgtggtggtgtgcgcctgtagtcccagctactcgggaggctgaggcaggagaatcacttgaacctgggaggtggaggttgcagtgagccaagatcaagccactgcactccagcctgggtgacagagcaagactccatctaaaaaaaaataaaaaaataaaaaaaaattagctgggtatggtggtgcacagctgtaatcccagctactcagaggctgaggcacgagacccgcttgaacccgggaggcagaggttgcagtgagctaagatcacgctactgcgctccagcctgggcgaccaagactccatctcaaaaaaaacaaaaaacaaaaaccaaaaacaaaacaaaaaactagttcctgtgcccatctcctacctatatactgtgaaatcttctctctgaagcccagctccccactcctgtgacctgtatctctcacccctgctgcttcctcctcctgtgtccttctgtgcctctccagcaccttccattgtcctttcctatcccaaactacaattcccatgggcttctgggccagtggttctccagctttatcttgcctaagattgaagacggggtaacttgtgtacatgtatattccaggacacactctgaaagatcagatttggtaggtctggagtgggcccaggaatctgctttttttttttttttttttgagtcttggtctgttgcccaggctggagtgcagtggcgtgatctcggctcactgcaacctccacctcccgggttcaagtgattctcctgtctcagcctcctgagtagctgggattacaggcgccggccaccacgcccggctatttttgtatttttagtagggatggggtttcgccatgttggccaggttggtctgaaactcctgacctcaggtgatcctgccaccttggcctcccaaagtgctgggattacaggcgtgagcctttgtgcccaaccagaatctgcattttcaacaagggcccaggaaactatggaagtgactccagggctactctttgagaaatgctggctgagatgacacctggactctaggggacctaagagaaacagctgcccacctaaataggcttaagggagggcaggcgtggtggttcatgcctgtaatttcaggactttgggaggccaaggcgggaggatcacttgagccaggagttcaagaccagcctggtaacatagcaagaccccatctctacaaaaaatcacgaaaattaaccgggtgtggtggcatgtgcccatagtcccagctacttggaaagcaggctgagggggaggattgcttgagcccaggagttcaaggctgcagaaagctatgatcgcaccactgcactccagcctgagcaatagagccagactctgtctaaaaaggcttatggcaaacagaaaacattgcgggggttggggagggggcactaagaccttggagtccctggaggtgagaacctcctggaggaagaagcagacacacctagagatttagagagatgaggtcccctggggtagcaagcaatccccaaaagggagtacccctcagtccccacccttcccgtctcacgttcgacctaatgtctcttccccgcacccagaagcatctaacctggtgggcgtcctactgggactgctggtgcctgtggtggtcgtactactggccgtgaccagagagtgcatttacagaacgaggaggaagaggtgagtcctgggaaggagagaggaagggcgggtggggtgtgcaaaccgggaagcggctgggcccgtaaagggccacttggggacccatgtctattcccccatgccttctagagagaaaacgcaggagggagacagactggccaggctggtggacacaggtgagaaccaaccccacagcccggaacctcggggcctagagttgagtctcctctcatacatggttttcttgctttctcctcagatactgttctggactgtgcctgttaagttgctcagttttgagctgtcttcagacaagaagattaaataaatttatatatttatttatttga

SEQ ID NO: 1106 - DNA, 64171 bp, Homo sapiens; identical to SEQ ID NO: 1105
